United States Patent 9,782,462 (MODIFIED POLYNUCLEOTIDES FOR THE PRODUCTION OF PROTEINS ASSOCIATED WITH HUMAN DISEASE) - sequence listing, part 12

SEQ ID NO: 12521 - DNA, 5137 bp, Homo sapiens
agtttggtctggagcagctgaaaccggtttgagcgtggctgcttcctgccgctcgacgccgcggcaggccgcctggggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaatctgtggttcaggaggaaaattccttttcagaaaatcagccatttccttctcttaagatgggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaatcct

SEQ ID NO: 12522 - DNA, 5454 bp, Homo sapiens
agtttggtctggagcagctgaaaccggtttgagcgtggctgcttcctgccgctcgacgccgcggcaggccgcctggggggagcgctggcgaggcacggacggcgggcgcccggtacctctgcccgcggtcctcgctctcgggcggggcggcggcgacgcggacctgcggactagcgaacccggagcacgacatcataaaataaatccatcagaatgacaccttctcaggttgcctttgaaataagaggaactcttttaccaggagaagtttttgcgatatgtggaagctgtgatgctttgggaaactggaatcctcaaaatgctgtggctcttcttccagagaatgacacaggtgaaagcatgctatggaaagcaaccattgtactcagtagaggagtatcagttcagtatcgctacttcaaagggtactttttagaaccaaagactatcggtggtccatgtcaagtgatagttcacaagtgggagactcatctacaaccacgatcaataacccctttagaaagcgaaattattattgacgatggacaatttggaatccacaatggtgttgaaactctggattctggatggctgacatgtcagactgaaataagattacgtttgcattattctgaaaaacctcctgtgtcaataaccaagaaaaaattaaaaaaatctagatttagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagaagatctcagtgagcacgtagttcagggtgatgcccttcctggacatgtgggtacagcttgtctcttatcatccaccattgctgagagtggaaagagtgctggaattcttactcttcccatcatgagcagaaattcccggaaaacaataggcaaagtgagagttgactatataattattaagccattaccaggatacagttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaaatttgatgctgatccagttgaattatttgaaattccagtaaaagaattaacatttgaccaactccagttgttaaagctcactcatgtgactgcactgaaatctaaggatcggaaagaatctgtggttcaggaggaaaattccttttcagaaaatcagccatttccttctcttaagatggttttagagtctttgccagaagatgtagggtttaacattgaaataaaatggatctgccagcaaagggatggaatgtgggatggtaacttatcaacatattttgacatgaatctgtttttggatataattttaaaaactgttttagaaaattctgggaagaggagaatagtgttttcttcatttgatgcagatatttgcacaatggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaa

SEQ ID NO: 12523 - DNA, 4015 bp, Homo sapiens
ttgtgacatgaaatcttcattttccaagtattggaagccaagaataccattggatgttggccatcgaggtgcaggaaactctacaacaactgcccagctggctaaagttcaagaaaatactattgcttctttaagaaatgctgctagtcatggtgcagcctttgtagaatttgacgtacacctttcaaaggactttgtgcccgtggtatatcatgatcttacctgttgtttgactatgaaaaagaatctgtggttcaggaggaaaattccttttcagaaaatcagccatttccttctcttaagatgggttcggcaaaagcagaacaaatatccgatactatttttaactcaaggaaaatctgagatttatcctgaactcatggacctcagatctcggacaacccccattgcaatgagctttgcacagtttgaaaatctactggggataaatgtacatactgaagacttgctcagaaacccatcctatattcaagaggcaaaagctaagggactagtcatattctgctggggtgatgataccaatgatcctgaaaacagaaggaaattgaaggaacttggagttaatggtctaatttatgataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatggggagtgtggcttctgagcagtttagttgctggggagagcagacagtcactgcctacaatacagacagaaccttcctgctcactttctgtcctatctcttcctgaccttatgaaccagtgttagtagatgattaaaacatgacaagcaatggctccttattttcacaggactaagtccgggccttcgtatcactagctgttgccttttacaccctgcttcagccaccctgtccctgtcattggccctggacttcctctctgtgcccgtgtgtcctctgcctgggagccctctcctcccatagtcactttctctctgccaaactcatttcttcttgtgcccaagacctctctcctgagcccttgtggaaacttcaggaaggatgaatccgtctttgtgctccacggctcgtaccttgatcaggctgtgcatcacagtaattctgttctaggtaggcagagttgatctttgtctcatctgccaggctgcaggctcttcaagggcagggaccttgtcatagtcatttttattttcacagtgcttggaacatggtggaaaatgaatgttggaattattggagtaatataatttgtatcaaatgtccttttgaattaagagatttagttatgtttactaagaatgtaaactttgaattggtttgcattttaacaattaggatggtttattgatgtgaattttgaaatgtagaggtataatgttaaattattttatactttatggaaatcaagtgaaatgtttgaaaaaatgccgccattatcctctggtattttctactctctggaattatgtgctgtaaatgatcggctgtaaatgtgaggcacaccacccacccctgtgtggaaagtgttgtggcgcttcctgccacccacccacctctctgccgttgctccttgtgacacttgtctgtcgtctcccatccaaactccaagcttacagctacctcagtactgctttgcttgtctgaaacacctcctttgccttccttcagtgtcccgctcaggtgcagcctcctccctaaagctcatctcagcttttgatctgaatgatgatggaaacatgcagacagcctctcagtcttactatttaatgttgtagctgggaaaaaacccagagaggttaactgatatactgggttgggactaggatgtgggttttgtgactctgaatcccatgttctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcaacaa

SEQ ID NO: 12524 - DNA, 2937 bp, Homo sapiens
actccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtgggaggaccagggcggcctcctgggccctttctccttcctgctgctagtgctgctgctggtgacgcggagcccggtcaatgcctgcctcctcaccggcagcctcttcgttctactgcgcgtcttcagctttgagccggtgccctcttgcagggccctgcaggtgctcaagccccgggaccgcatttctgccatcgcccaccgtggcggcagccacgacgcgcccgagaacacgctggcggccattcggcaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggaatgatttccctgatgaaaagatccctaccctaagggaagctgttgcagagtgcctaaaccataacctcacaatcttctttgatgtcaaaggccatgcacacaaggctactgaggctctaaagaaaatgtatatggaatttcctcaactgtataataatagtgtggtctgttctttcttgccagaagttatctacaagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccggcctacttgaagaagtggtcagctaaaggaatccaggttgttggttggactgttaatacctttgatgaaaagagttactacgaatcccatcttggttccagctatatcactgacagcatggtagaagactgcgaacctcacttctagactttcacggtgggacgaaacgggttcagaaactgccaggggcctcatacagggatatcaaaataccctttgtgctagcccaggccctggggaatcaggtgactcacacaaatgcaatagttggtcactgcatttttacctgaaccaaagctaaacccggtgttgccaccatgcaccatggcatgccagagttcaacactgttgctcttgaaaatctgggtctgaaaaaacgcacaagagcccctgccctgccctagctgaggcacacagggagacccagtgaggataagcacagattgaattgtacagtttgcagatgcagatgtaaatgcatgggacatgcatgataactcagagttgacattttaaaacttgccacacttatttcaaatatttgtactcagctatgttaacatgtactgtagacatcaaacttgtggccatactaataaaattattaaaaggagcactaaaggaaaactgtgtgccaagcatcatatcctaaggcatacggaatttggggaagccaccatgcaatccagtgaggcttcagtgtacagcaaccaaaatggtagggaggtcttgaagccaatgagggatttatagcatcttgaatagagagctgcaaaccaccagggggcagagttgcatttttccaggctttttaggaagctctgcaacagatgtgatctgatcataggcaattagaactggaagaaacttccaaaaatatctaggtttgtcctcattttacaaatgaggaaactaaactctgtggaagggaaggggttgcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaaaaaaaaaaaaaaaaaaaaaaaaaaaaagataactagaacttctagaacatcttgtttacagttagccagaaactatacaagtggtttaacatgcattatcttactcaatccatacaaaagtcttatggaggtgttagcactctttctactgatgaagaactgaggtacttcataaaaccacttacccaaggtgtcttgagtctggtacaactggcattcaaatctaggtcagtctgcccccagagccactacccttacccctcactgaatctgcctttatattgttgagcccatgaccccaaactgctctttccaatttgaacttccagggattttattgtgaacttacatagcaacattaaaatgaagttgaattgtttttaatggcaacgccgtctgtctcctctagcttaccgcttctcacctttcaaccccatctgtggcctttgtccaggcccacagcttagccatggcttccctcctgcatccctgccgtgggttgctggcctcacacttgcagcagctggacagtgattttagaaggccaccagtccccatagctatgtgacaatgagaagcaaacttttttgtgacagattgtattggcataggcatgatagatggggattggtacgttttgaatcagcatttgcaaaaaaattgtcttgaattttaaaataaacaacaaagatttgttcattgagtgcaa

SEQ ID NO: 12525 - DNA, 3523 bp, Homo sapiens
cggggatgacagcggaggtggcagcggcgcggcgctgagcgagcggcgagggagcaggggaagaggaggaagtggagccgcggccgggagctcgggagtcggccgccgcgccgaggttcgccccgttttgcagagagagccgagtcgggacctggaaagacttccccgcggggctccggccgccgcgcctccccgccggcgcctgccctgccctgcccgtcccagccccgcggttcggggcgtgcggccgggacgcgcggagccccggccctgacccgctgcgccgggacgggacgctcctaacgccgccgtaccggtccgtggttgcagggtcgctccgcgcctttccgtcagtgagggtcggaaccccagctccagggctagcgcagtgtggccccaggccctcgcctccggtgcacgggaccccggacccccccagcctctggcttcacgagaccccaaccttcagttggaacagcttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 12526 - DNA, 3084 bp, Homo sapiens
ggccgggagctcgggagtcggccgccgcgccgaggttcgccccgttttgcagagagagccgagtcgggacctggaaagacttccccgcggggctccggccgccgcgcctccccgccggcgcctgccctgccctgcccgtcccagccccgcggttcggggcgtgcggccgggacgcgcggagccccggccctgacccgctgcgccgggacgggacgctcctaacgccgccgtaccggtccgtggttgcagggtcgctccgcgcctttccgtcagtgagggtcggaaccccagctccagggctagcgcagtgtggccccaggccctcgcctccggtgcacgggaccccggacccccccagcctctggcttcacgagaccccaaccttcagttggaacagcttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 12527 - DNA, 3106 bp, Homo sapiens
tggtgcctgactcctcacccttcccctgcctcactgccctgtgcttcctcctgcaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaaggcctcctctgggcttccactatcccctctgtgagggagtttcttctcctggctgcaaagctggcatttgaaagaactgcaccagctggcaccccgggtggggctggcacatgctgtggtcaccttctggggccatgcctggctctcagcaggctgccctgagcacactgcactgctcttctgtcctcgcctgactcccctgcctcagtggcagcagcccccagcccaggacctgcacagaggaggcgtctgtcagcgacccaacctgagccccagagaggagcactgggtaccacacagccccaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 12528 - DNA, 4150 bp, Homo sapiens
tcacagctctggaaaggtccctggagaggatgtggaaagatccccagtaggtagcagagccaggattcgactgaagaccgtgattcaagtgaggctcttaaccctgggccagctgtctgccatttggactgcaaaacccagaggccagatacccctaagaggccagctgttgcacctctgcaaggcggggttccacctcctctcgggtcccggcacctaggccagactcatcgaatgaatgaaagactctgttgtatcccctgtacccaccatggctatcacaagccacagtcccatgaagacagagaacccaaggccactttctcagaggaggacggtgatctgtctctgggcctctagggtgggattcatccttctcagtcagatttcaggagcgatggtggttgcgtttttgggtgtcagtgctattgctataacttaatgatgcaaggtagggaagtcccacagacactgaacatgcagtgatgctgctgagtgtgttgattagcaccaaagcaactgtggaactcagagataataacatttttaattgtattagggtttggggaatcagttttattgcaagtcgtttccattaataggtattgtgatgagatgctcctggaaaccatccttaactcactgtgtgcagggccacctcccacgatggccacaagggggagctgcgcgccgggggcagccgggagaaggggcctgagtgccgagggcggggttctcaggggttcggaggcgcagctgggcctcccagagactgcgcagcctctctgacaccagcgtgctgtctgtccgagaaagcgcacacccccttaccccctgagatgggcagaaggtgttcgtttctggttctgccccttcaaagctccgtgacccagccagctgttcctctccccgaacctcgcttcccgtgtgtgagatgaggatgctcgtgcctccgcggaaccaacctggggaccacgcgaagcgcccccacaggcccaggctgatgggctggaatgaaaagcctccaaagggaaacttcatcccaggcgagactcagcattccccgccggcgagtgaaggtccctgggtagggagcggagatgctggccaccgccccaccctcatcgtctagaaatgccactgtccctgctcggcatcagagggccctggccgctgctgcctctgggaaaggttgcctcgggagaaagggggtgaaggccctgccagcagctagaacggctccagggaggcagggcggccggcagtgctgtgggagaaggacaggcctttggagggagatgggagacgagtctggagaaactagggggacggaggtggcggctttgactgacccttccagagactgggatctgcgggaggctttggaggagagccacaacctgggcttcggggaggcacgcctgggggtgtggaggggggtgggtggagtgagatccacggctaggggcgaggggctgggggccgaggagccgaaaacctctgccgagcttcacgtggttaaagatttcaggtcttacctgtcaccagagatctctgtcccgtagaggtgccacctcatcctccatgagagctgtgctttgctttcttctggaggctgcaaggaggatggcccccatcacggcggacctagatgctgggagtccgggagagggcaggccgtggagatggggcaggtggcgatgtgtttcaccacccactcccgcctgaagtgccactgtgagcccagcccagggtgccaggctgggctgcactccaggctcctgcagcagacccagttcctcagcctccttcccctgaggcctgggcatggcctggacaaatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 12529 - DNA, 3222 bp, Homo sapiens
ggctgctttagaagaacaagctggtttggcagctacctcagagaagcaggaccctgggcagcgtgaaagggcctctgcccccagggtggctgggctttggatcctggatccgtgggtcctggaggggcaggagtggttcaggaaacagctctcccagtgaagtgatatcactgcctctgtggacaagacacctccaggagcccagctcacagccaccggtaccttcttccagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 12530 - DNA, 825 bp, Homo sapiens
ttggaacagcgcgagcgcccgggaagccctggccgggtcgtgcgctcggtgaggggtcctaggcgggcaggacagtcggaccgaaccgccgggctggtgccgcgagcccaggctgtcaccttcgtcccgcctcaggtgaggggttcagcgcctgccccgaagataacacaggggtccccttctgtcccggcggcctgcgagagccaaggctgcagctctcccagtgaagtgatatcactgcctctgtggacaagacacctccaggagcccagctcacagccaccggtaccttcttccagggctgctgttatagtttctgcatggaaagcacttggaacaatgcctggctgttcccctctttggccctctcagggccctaggagcctttgtgtgtcctgctcacattgtctccagggcctcggacagggcctggtacagaacatatgactgagtttctggagtcccacaggccagcgttggagtcctgacacctcagtatagctgtgcacctctgggcaaatagtttctctgctctgagccccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgtgggagcgcctctggttcctgctcctcaccttcacctttggcctcacgctcacctggctttacttctggtgggaagtccacaatgactatgatgaattcaactg

SEQ ID NO: 12531 - DNA, 2441 bp, Homo sapiens
tggacaagacacctccaggagcccagctcacagccaccggtaccttcttccaggacaagctgggggcctccatgggcgcctgagggccaggcgccagggccgtgggcacgagtatggtgagacaccagcccctgcagtactacgagccacagctgtgcctctcctgcctcacgggcatctacggctgccgttggaagcgctaccagcgctcccatgatgataccacaccgggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttga

SEQ ID NO: 12532 - DNA, 2424 bp, Homo sapiens
cggccgtggcccagctgtgggaggacgagtgggaggtgctgctgatctccctgcagggcacagcgccattcctgcatgtgggggctgtggcagcagtcaccatgctctcctggatcgtggcaggacagttcgcccgcgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatggcatcaggagaaccctccaggagagctgggaggcagctcagagcccactgtgacagtgagtacggctgaaccgacgtgagttggagaaagacgaagggatcaaagtcagcgccgcattctgccaccagtgcactccatagccctgcaggagagcttcgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacgccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtctcctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcctctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgattaaagctgccatcttg

SEQ ID NO: 12533 - DNA, 2597 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgataccgtatgtgtatttttattctaataaacttttgtgttccagattgaa

SEQ ID NO: 12534 - DNA, 1522 bp, Homo sapiens
cccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgaaaacgttaaatgagaagaactaaagaaatgacatgctaggtttgataaatggtttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgccc

SEQ ID NO: 12535 - DNA, 1495 bp, Homo sapiens
gtccgcgatgcgcacggctcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtga

SEQ ID NO: 12536 - DNA, 1656 bp, Homo sapiens
aggctgcgtccgcgatgcgcacggctcccaggcaggcaggcgcgctcgggcgaggtaggagcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggccttttccatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggcccagtcctgtggccggttgaagaatcaggcaggagccagggctctgaggggaggcgcctgaggactgcagatctccactgacctctttccctagattaagatgggacccagtggccgggcacggtggctcaggcctgtaatcccagcactttgggaggccaaggtaggcggatcacctgaggtcgggagtttgagaccagcctgaccaacatggagaaaccccgtctctactaaaaatacgaaatt

SEQ ID NO: 12537 - DNA, 1517 bp, Homo sapiens
gcgatgtggcctgggaacgcctggcgcgccgcactcttctgggtgccccgcggccgccgcgcacagtcagcgctggcccagctgcgtggcattctggagggggagctggaaggcatccgcggagctggcacttggaagagtgagcgggtcatcacgtcccgtcaggggccgcacatccgcgtggacggcgtctccggagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccagagcatccacaagaatctagaagcaaaaatagcccgcttccaccagcgggaggatgccatcctctatcccagctgttatgacgccaacgccggcctctttgaggccctgctgaccccagaggacgcagtcctgtcggacgagctgaaccatgcctccatcatcgacggcatccggctgtgcaaggcccacaagtaccgctatcgccacctggacatggccgacctagaagccaagctgcaggaggcccagaagcatcggctgcgcctggtggccactgatggggcctttcatggatggcgacatcgcacccctgcaggagatctgctgcctcgcctctagatatggtgccctggtcttcatggatgaatgccatgccactggcttcctggggcccacaggacggggcacagatgagctgctgggtgtgatggaccaggtcaccatcatcaactccaccctggggaaggccctgggtggagcatcagggggctacacgacagggcctgggcccctggtgtccctgctgcggcagcgcgcccggccatacctcttctccaacagtctgccacctgctgtcgttggctgcgcctccaaggccctagatctgctgatggggagtaacaccattgtccagtctatggctgccaagacccagaggttccgtagtaagatggaagctgctggcttcactatctcgggagccagtcaccccatctgccctgtgatgctgggtgatgcccggctggcctctcgcatggcggatgacatgctgaagagaggcatctttgtcatcgggttcagctaccccgtggtccccaagggcaaggcccggatccgggtacagatctcagcagtgcatagcgaggaagacattgaccgctgcgtggaggccttcgtggaagtggggcgactgcacggggcactgccctgagctctgggtaaggacgagaagagccaaggtccgcctactgccacagggtcaaaggaggttttcgatcagcccagaccagaggctctgagccctgaaccaaagtcccagagctgggctgggacgtgacctgtgctgagggctgtgagaatgtgaaacaacagtgtgaaaattggctgtg

SEQ ID NO: 12538 - DNA, 1552 bp, Homo sapiens
cccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaa

SEQ ID NO: 12539 - DNA, 3767 bp, Homo sapiens
cccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctgtccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaa

SEQ ID NO: 12540 - DNA, 1072 bp, Homo sapiens
gcggcgcaggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactggggtggactccattatgctggtggaagagggcttcagtgtgacgagtgtggatgccagtgacaagatgctgaagtatgcacttaaggagcgctggaaccggcggcacgagcccgccttcgacaagtgggtcatcgaagaagccaactggatgactctggacaaagatgtgccccagtcagcagagggtggctttgatgctgtcatctgccttggaaacagtttcgctcacttgccagactgcaaaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataagagtgacttgaccaaggacgtcacaacatcagtgctgatagtgaacaacaaggcccacatggtgaccctggactatacggtgcaggtgccgggggctggccaggatggctctcctggcttgagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgca

SEQ ID NO: 12541 - DNA, 1803 bp, Homo sapiens
gggagccaacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagactaaggaagagaaggggaacggagggagggggcacacttacacaactctctctgcaatatgtgcaatagcaaaatgcagtgatgcatgaatttta

SEQ ID NO: 12542 - DNA, 1707 bp, Homo sapiens
caacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcagccttgctgcttctaaggaggctgaagctgctcgctccgcacccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaagagccccatgttgaatctattccaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaat

SEQ ID NO: 12543 - DNA, 1555 bp, Homo sapiens
caacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacatttttgcccccataactcgtggactacaaagcacaaggacctgaaaaatgtacagcttcaatactcttcgactctacctttgggagaccattgtattcttcaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaat

SEQ ID NO: 12544 - DNA, 3216 bp, Homo sapiens
acgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggacggctttctgcaaagaccatgactccaggtctggaaaacaaccttcacagaccctatctccttcagatttcttggacaagttaatgggaaggacatcaggatatgatgcaagaatcaggccaaattttaaaggtcctccagtaaacgttacttgcaatatttttatcaacagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgcaaa

SEQ ID NO: 12545 - DNA, 1730 bp, Homo sapiens
gcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggacggctttctgcaaagaccatgactccaggtctggaaaacaaccttcacagaccctatctccttcagatttcttggacaagttaatgggaaggacatcaggatatgatgcaagaatcaggccaaattttaaagggcctcctgtaaatgttacctgcaacatatttatcaacagctttgggtcaatagcagaaactacaatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgaca

SEQ ID NO: 12546 - DNA, 659 bp, Homo sapiens
cttgattaatcagatgaatctgcatatgagaatgacggctttctgcaaagaccatgactccaggtctggaaaacaaccttcacagaccctatctccttcagatttcttggacaagttaatgggaaggacatcaggatatgatgcaagaatcaggccaaattttaaaggtcctccagtaaacgttacttgcaatatttttatcaacagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctact

SEQ ID NO: 12547 - DNA, 3182 bp, Homo sapiens
acttccctcaccctctccgtctcccgacctctcttctcctcttgctgtcatcgtacccccttcagtatcccctcgctgaacggccagtcactctttgccttcgaacagcaggcacgtcccctcttgaatgcttttccccgacccccgccccaagcaactgaaaaaggaaacatgcgcacttcagagcttggagctgtccgagtgctgaaatttataggctgggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcagaaccaagataaatggaacacatagtaataatgctatgaatactgggaaaacccactatgttcctttcaggtttacacctcctactatgattaagaaaaaatataggctggtttttattagaatcatcatcatcatcatcatcctcaccaccaccaccatcataatcaaataatacttgattaatcagatgaatctgcatatgagaatgacggctttctgcaaagaccatgactccaggtctggaaaacaaccttcacagaccctatctccttcagatttcttggacaagttaatgggaaggacatcaggatatgatgcaagaatcaggccaaattttaaagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcatctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggagggagggtcatgggggtgggtttcctggcacctacatgaaaaaaaagacaagttatatgggtgatgaagaaaactgcacaaaattaaggggttgcagaatcacgggagcataataattcccttccataatctttagcattgttctttcagtcagacatgatatgcgcaacattcagacatgatatgcgcatcattcagacatgatatgcggggtcaagttcttaagggctgtttgccttttggtccttttggtttggtttggctttgactaattctggtactgaaaagttagctatacacacacacacacacacacacacacacacacacacacacacacacacacacacacacaaacttcaaaaatgcttaaccatctgaccatagtgactagcctatagtgagtcgaggaccaaactttttcaggaaaatgctgcctcgtttttaaaacaagcctcctaagctatgttctttacaatgtctgtaattagtgtttcacttgagaaagccttttgtgggtcgtaaattatttctacttatccagtaaataacaatgacaaaataaacaccaatgacagaaaaatttctactttactgtccatataggtgtgcattttaatatttttctttccaagataaaattttgaaacttaaattgtgtattgtgtaattaatttgatagtgtaccctcttaataaatgcccactttattttatatccaagttagtgcattatatatatatttttgctttggctatatttacacgtgactttaatcgcccaactgtgactagtcattgcagctactcagctacagtatttatggagatggtgtgtcctgaacagtgtagctcaggtcagcttgaactttccatttctgctctcattgtaggtgtaactactagtcctaatgtcaactgacccatgatttctactgtcagtcaatataagtgaacattgttttaaatatccttaactaacttaaagaattttaaaattgtactgtgattttcataacccgttgcctttttggtaccagagctacgtggtttgaattctggctacatgttttaagtaagaaaaaaaaagacgtatttttgcttactcagataaaagacaacctgtaaaaatataataattaaattttacatgtgctgtacaaggggttattttaaaaagcatttgttcaatttcaataaagctaagtgtgccgc

SEQ ID NO: 12548 - DNA, 8770 bp, Homo sapiens
gtcgacaggaccgggttgtccggccccacccccgcttccctttgccgcgctccgggtctcgggttttaacccaaggtggagagctggattccggcgggcggcgcttggagcaggtggagaggcgtcctctttccggctgttgctgctcttcttcctccaatcctgggtctcagtcagggaagaacgaacattcttcctttgctgctggagctttagagaactgttgcccagcacctaggcacttcagacatttcatctcactcatttttgtaatttcactgtaaaaatcacctgcacatttataacactgtgactctccacttctgctcaatgctgagaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagctttggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcattctggatcaacatggatgcagcaccggccagggtagctctggggataaccactgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataagacagaagcttttgcactggagaagttttaccgtttctcagatatggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaaccaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccagactctgactctttttcagttttgctatttttttaactatttttaccataaatttatttggaaaagctttggaatgctttttaggtattttaattattggtcagatgcacaaactcagtccaccaaattattcacagagaaaactttaaagattaagaaaacaatgaactcagatgtacaatagaaaagccagttctttaacaagatgctattttctacccttcaaccactttcaaattaaaagcaaaaactaccatttaaaactaaaacctttacaatgttattgtacatcagcttatacaattgtaattttttaaaataacattttaaaaaatagtaaatgttaagcagtttttgctagtaaaagaccaagttcccctcctttataagtaacttaaaacaacactataaggaaataatatcatgtttggcattatgtgcaaatgacacaaccaaaagaatttgttactctgtaagtacccacgttgaggactgtgcacctgaaaattaaacatatgcttcttcatttggtgtgtatttaacaaaaccatggaaacatattcttgttctaaagattagagcaagatatgtcatttgtattccttgagaattagcaggagagtttgaggtaattataaactacatcatctcgatgtgtctctgaaatacctgaatacgtttttctatactttccacatcttatttcaaaagtttcccaacattgcttaagtgaattctgccaggagcaaacagaaatataatgaatgcaaacatgcttacttccaaaagaaattcacagacatcacttctttccatatttgagaatattataaatgtgtctttgttaaatcagaaacttagaaagtgaaaataccaaacatgagacaatattgtcaacaaggacgttggtacattagaaatctatctcaaaagtattacactttccttaggcatagttttcctttcctattatatttgtcactgtcttactgcactaagaaaatactttaacagctttcactcacaaggcaacagtgacaaggtgcatgtggctgaatccaatatgtttaaaggaatgtgtctcctccttcgaactcttatagaccttttaaaactgaaaaattacattgcagttagcatcctgagataatatttgcctcaataagccctgtgtccaaccagaatattttaaattaaaccaaccacaaaattattaatggcaagaaattaaaaatgtgtgcatatacattaactactaaacacacaaattggaattccaatgtgcatattctgaagtattttaaaatagccacattagaaaatatgggattttcatgtatgcagtttatatcattttcttaaaaagaattatttgtatgtcaatcattgaaatatttgattccatagcatatgaatttataggctatcttatacattagcatatatgtgcccaaccttttctttctttcccaaccattagaattgaacttaaaccataatgaggctctagaacttactttacaactttaaatagattcaagagtcactgtattttcaagaaagctgagggtgtttaaaacttctccaacccttccaaaagtttctccatggcgctggagaccccatccaactctcagtggctatattagggaatcatccggactgctcatcttattctaaaattaattcttattctgttgatatattctaataacttttatcttaatttggaatttaattgcttgtatatttatatatccctaagacatgaattcatgtattagtttatgaatacccaggatctcatggaaggtaagggaaattttagaaaaaaaaatgaataatctaaatgtttaactaacagaagagagcaagctgttcactactttagtactcagtgcaacttaagtagttataatatttgaaaaaagatttagatgtatcttccatactatacatccctttttctgaacattttttattccactttttaaaatatgcttttctatttttctcaacacaacatacttcaacctgctggttacttgggaggactgaatattatactggcagctaaatttttatttcatctataaagtacacattccaggaaatggacatgagagaatacaagagacttgccaaaattgaaatggaaaatacttgcagtattttgtaaatggaaaagaaggaaactgacagcattgtttttcacaggtgtcccctaaaaatttagaacactctaagaacaaaactctgagaacaaaaatgtatctaatgatccttagacagatatcattaacaatccttgaggtcatgatatcttctactccaaaagtgattccacactctttgcaacatagataatagcataaactcccaaaatttatcagcatatacgacctatatttttcatctagttaatattgaactagcaaagaaaagcaagccattccaaatataagacaatctggtgttaatacaatatattagaagaaatagtgtaaatgttcacacagattccctcttgcaaataaagtacccataatacccattgcatcttgtacctgtataagagacatcttcctcagcagatgcattggtttttatttccttatttgtgtgctacagtggtaaatatagcctcactgcattttttttattgttatataaacctttcatggataaataagcagtgtacactgtaaattgcattaatttaattaactttaaaattaaacttttatctcagcccccattcctctttacaaacatagtgatattaaaaagtgaacttccatagggagacacctggtactccaattacttcaaaagtaaagtgatgcatattcttccataacaaagatacttataggccatgtgtaaaatataactctctacaatttaaacggaactagggcagggaaaaatatcctggggaagcttcttccagatatgaggacaagagatataatcccaagttagtagctaggacccacttacctgtttttttggtctacattttacatcttaataatgccttcatctcttccctttccctctctctctctctctttcacacacacacacacacacacacacacacacacacacatacacatattggtaatgagatgaattcctttagattaaaaatacaaagacagtcaatttttctagacaaaggttcataatcctgtgatatgttttgcaatattaagtgattcctggtggaaaatatgaaccatgcagtcattcgatttggccagctcttaatcatgcaacaatcttttgcctcaaaaacacataaacaaagctaactggatcaagtctttaacccttaacaatcgaattctaaaacactatttgaaccgtttttgaagaacagctaaataactgtcaaaaacctttttcaaaagacagctagtaatattggatgactttgtagtgtctgaacaggtggttttctcagtagtttttgtggttaacacataaacaaagaggagacatttaaggtgatggagtattatttttaaaaagtgattttgaaccctggctatgtgttggaattccttacacattttaaaaatacatacatatgcttggtgtccaacatagaagattatgatttaatcattgattaaacaaatattcattgagtaccttatgtgtgcctggcactgtcccaagtgctaaatttagtatttttggaataagatctgaaattctggatgattgaaaaaattccagaagtgagagaattcgtgtgaacttacacaagcttattctcttaataaggatcaatttaacactttttaagttttatcattttttctttcttcaagcaactaattttagttgtctctcatttatattcttagaattaaaaataggcccggccaggtggctcacgcctgtaatcccagcactttgggaggccgaggcagtcaaatcacttgaggtcaggagttaagacaccagcctggccaatatgataaaaccctgtctctactaaaaatacaaaaattagccaggcatgatggcaggtgcctgtaatcccagttactcaagggaggctgaggtggaagaatggcttgagcccaggagatggaggttgcagtgagccaagatcgcaccactgcactccaaactgggtgacagagtgagactctgtctcacaaacaaacagacagacaaaaaaagaatttaaaataaatctttgatgcgtttcaattcagctttcctcccaatgtcagaatcttcaccattacattatccacattcttcgagcacccagatagcaacaggtagctcattactctgagggcagtcttctgttccattgtgacataactctagatgataaaaatgttaatcttcatcaagaaatgacttttacttcctaaaataccaagtaagtttattcccctcctataagacaactagcatatattttcacatttctgctgtctgtgtttaagttcaatcaaccccttatcactagctttattcttatttaaaccattcatgagagcattgtaagtgttaaacaatgatgagatattttcaggcttataaaataatgaaatataaaattaattatctacatagataaatagaaattgatgaaaatttctatgtatattattttcagtaactgttaatgtcttcctataacagcaataaatttaaattaaatatttttaaatttatttcagatatgaagatattatataaaactctacaaagtaatatgaatttaaaaaaactagcagcaaaccatattaaccatattgtgtgtttttagagtaaagctataacaaaagtacaggggattaagttgttttattttaatagctgcttttactctggggtggttttagcaatggcgcctttgggcaaccccgctcacatacacagtatccagcctgggtggttaatactagggagctgtgacttaaatggcaggaaaggattcagatgtaaaattgtacttgaatatgcttgaataattttgcacttcttcacttttttctctatgaattattcaatggtcattacttaaatttgtattttaatgtatgataaatgataatatggggggggaaatagagtgaagtaccctgacattctacagatataatatgatatgctatgaaaaacaaaacaaaaagaaaatgtgccatatattttccatgtaccatctttatatgatatacagtgacttcattattagtgagtcaagttgtttaaaggactaccaaaagaagtattgctattttatggtttttatggtgtaaattatttttctgtcttcttgagtcttatgtctaagtctgtcttccttgtccagatgctgtcatatttttccaggaaattatactgaaaacatatttaaaaatttatgcacgatttcatcaacttgtttttcattatattatatttagttcaattttgcaactaacagactctctatcagagtcattaacctgtgaacagtataaagtatttaacatgtaactatagataatttgatccgaaacaataaaaatgaacacttttcaagaatatgga

SEQ ID NO: 12549 - DNA, 3065 bp, Homo sapiens
attccggcgggcggcgcttggagcaggtggagaggcgtcctctttccggctgttgctgctcttcttcctccaatcctgggtctcagtcagggaagaacgaacattcttcctttgctgctggagctttagagaactgttgcccagcacctaggcacttcagacatttcatctcactcatttttgtaatttcactgtaaaaatcacctgcacatttataacactgtgactctccacttctgctcaatgctgagaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagctttggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcattctggatcaacatggatgcagcaccggccagggtagctctggggataaccactgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataaggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaaccaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccag

SEQ ID NO: 12550 - DNA, 3126 bp, Homo sapiens
ccgcccgcggtcgccaggttcccccgcggcccgcgctgtccccgctgcggccccgaccgcggcgcgccacggcgcaggctccgcggcccgagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaactctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgc

SEQ ID NO: 12551 - DNA, 1757 bp, Homo sapiens
ggggcggcggagcgcgaggagcactgcggcgtgcccgggaggacgcgcgctgccctgcgcgggagaggggcgcggggcgcctggcagcggcagccgggtccccgctgcggtggcgcccgcggagacgctccgggtggagagatgcagagggccgggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaactctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaa

SEQ ID NO: 12552 - DNA, 2765 bp, Homo sapiens
acggcgcaggctccgcggcccgagcaggcgcgtcagccgagctcggcggtggcgcgggcggctgggacgcagctgcccccgctcggcgcccgctgcacccttagcagccactgccacctgggcccggagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaactctgctcattgttgttctctcctggctttccttctggatcaacccggacgcgagtgctgccagagtgcccctgggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgc

SEQ ID NO: 12553 - DNA, 1150 bp, Homo sapiens
agaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatgtgagtttgataaaatccagtctataccactcacacctctcaagtaacctcccaacttctctccctgcattcactctggctttcctacaatcaatgttgtacaaagaaatcagaattacatttttaaaaaatgtaactcagaacatgtttctctcctgcttaaaagactccaccatctcccttctcatctagaataaaccaggcctctggctaccacttggacctttattgcccttcctgctttcttcctccaacagctctgaccttcactctgttcctctttcatcacaagctcatctatattccaggacttcacatttgttatttcttctgtctactctgtctctcaagacaatagaggtcacagcaaatacaaacctttatactaatggattttgttttcttcttggaccctccatagcaaccaagagatgtttaaactctcatccatggatgttacccatgctcacttggtgaataaattctggcattttggtggtaatgaga

SEQ ID NO: 12554 - DNA, 1735 bp, Homo sapiens
ggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagtaaaggagtgggcactgtttggactctggggaagcagtgtgatgttcaacagcatcgccatggtccctgcattcacaggtttctcagtgggaagcaggcccaggtcctcttacatttgacataagcaatttacctccccacatttccaggacctctatgacacttcatcagatacatattgctccaaattacttctcctggaatccctggttcctcagttgcaagacccttgccagtttttctgggagctaggaagaggtgaattaaattttctgagcactatgacttctttctttctaaagcctttcccttatgatcaacaagtggactctcctcagcaggtctttagagattatcctctcctgttattgctactttataggtacattaaatatactggacacaaatatatatgggatattaggctaaatacagtatacatgatatagcagggaatgttactagaagaaatatcaactgatgatatcctatcctctccaagctcctattccaggaaaaaagatccaatgttttttctaaagatgagcttccaaaacccacaactcctaaataatacagaaagttttgtgtttgactgtatacaa

SEQ ID NO: 12555 - DNA, 1070 bp, Homo sapiens
cagtgacagtccttgtgctctggttagattccatatccctgaacttcaacctgaaaacttccatcagctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccaatggtggcaaacccaaggccatcaaccaagagatgtttaaactctcatccatggatgttacccatgctcacttggtgaataaattctggcattttggtggtaatgagaggagccagagattcattgagcgctgcattcagacctttcccacctgctgtctcctggggcctgaggggacccctgtgtgctgggatctaatggaccagactggagagatgagaatggcaggcaccttgccggaataccggctccatggccttgtgacgtatgtcatctattcccacgcccagaaattgggcaaacttgggtttcctgtctattctcatgtagactacagcaatgaagctatgcaaaaaatgagttacacactgcaacatgttcccattcccagaagctggaaccagtggaactgtgtacctctgtgatgccaatcctgaacataagacagtgttgggcaggtctgggcgtataatttgaggagtggatggtggatgaaaagaaataataaattgtaatcagcagt

SEQ ID NO: 12556 - DNA, 3378 bp, Homo sapiens
cagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaa

SEQ ID NO: 12557 - DNA, 3574 bp, Homo sapiens
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatccca

SEQ ID NO: 12558 - DNA, 1276 bp, Homo sapiens
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaagggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccaggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccat

SEQ ID NO: 12559 - DNA, 2561 bp, Homo sapiens
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaagggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttca

SEQ ID NO: 12560 - DNA, 1503 bp, Homo sapiens
agtgacgctgcggcctccttctgcctaggtcccaacgcttcggggcaggggtgcggtcttgcaataggaagccgagcgtcttgcaagcttcccgtcgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgcc

SEQ ID NO: 12561 - DNA, 1890 bp, Homo sapiens
ccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 12562 - DNA, 2052 bp, Homo sapiens
agcaggggcgccggtgagccgcagccgcagcggcagcctagccccgagggagggaggaggagccgagggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccaacatgactcatccagagtttctcatcctgtggtggaacatctttaccaccaacgttttacctctgcttcaacaatttggccttgtcaaagacacctgctcatatgtaaatgtgctttcagacttggtctatacactggctttctcttgtggcttctgtagaaaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgta

SEQ ID NO: 12563 - DNA, 1563 bp, Homo sapiens
gctggccgcgctccctcccggtgccggcttctctgagtcaccaacctgaggctgccccggccgcctgcgcacccggcagcaccatgacagatcaggcctttgtgacactaaccacaaacgatgcctacgccaaaggtgccctggtcctgggatcatctctgaaacagcacaggaccaccaggaggctggtcgtgctcgccacccctcaggtctcagactccatgagaaaagttttagagacagtctttgatgaagtcatcatggtagatgtcttggacagtggcgattctgctcatctaaccttaatgaagaggccagagttgggtgtcacgctgacaaagctccactgctggtcgcttacacagtattcaaaatgtgtattcatggatgcagatactctggtcctagcaaatattgatgatctttttgacagagaagaattgtcagcagcaccagacccagggtggcctgactgcttcaattccggagtcttcgtttatcagccttcagttgaaacatacaatcagctgttgcatcttgcttctgagcaaggtagttttgatggtggggaccaaggcatactgaacacattttttagcagctgggcaacaacagatatcagaaaacacctgccgtttatttataacctaagcagcatctctatatactcctacctcccggcatttaaagtgaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtacctttcacgagacctgaattttagaattgcccagtgctgccagagtgagtgagtgtaattctcctttcaggtaaagataggctatctcaacactgctgagtgattcataaacatatcaaccaatagcattaacccattttatttcctgtccttagtgtctgaagatgctcaccagttttctgtgtacagtaaggcagcatgctaaaatgcttttgttcagttctgtatatttgaaaatagcagtgtgttctctgatggttacctgcagtggcaccctgtacaaaaaataaaagacttattgctgt

SEQ ID NO: 12564 - DNA, 3277 bp, Homo sapiens
cgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgtt

SEQ ID NO: 12565 - DNA, 3393 bp, Homo sapiens
cgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgttaaaaaaca

SEQ ID NO: 12566 - DNA, 1956 bp, Homo sapiens
cttcccggcagccggggctgggcaccaggcggcgcgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatatgatagcttgtcctgaaactgagactcctgccgtgataacgtgtgacccactgtcccagccttcccctcagcctgcagacttcacagagactgaaaccatcttgcagccagcaaataaagtcgaaagtgtctcatccgaggaaaccttcgaaccaagccaggaactccctgctgaggctctcagggaccccagtctgcaggatgcactggaggtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcaga

SEQ ID NO: 12567 - DNA, 624 bp, Homo sapiens
agtgcgccgagccagggcaccgagtgctggggaatacaggccgtccaggcgcggcggggcgcggggagacggaggctgccggagcctggaaatccacgcggattcccggagacggcgcctctgctctgcgggttcgtggcgaggaagtccacccactgctcccgggcgcaggtctgcaggtccgcgcccactgcccgcggcgccactgaccatgtcggtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggt

SEQ ID NO: 12568 - DNA, 3172 bp, Homo sapiens
cgcgggcttgcgggcaggggctgcagggaggaggagaggacccgcgcccgcgggggctggcggaggcggggccgggcttccggacagaggccaatcgctgccctcggggcctccagcgccggctctgggccgaggcagccagagcgcggaagaggcctggaaatccacgcggattcccggagacggcgcctctgctctgcgggttcgtggcgaggaagtccacccactgctcccgggcgcaggtctgcaggtccgcgcccactgcccgcggcgccactgaccatgtcggagacagagtttcaccatggtgcccaggctggtctcgaactcctgaggtcaagcaattcacccacctcagcctcccaaagtgctggaatgacagtgactgatcaggcttttgtcacactagccaccaatgacatctactgccagggcgccctggtcctggggcagtcactgaggagacacaggctgacgaggaagctggtggtgttgatcactcctcaggtgtccagcctgctcagggtcatcctctcgaaggtgttcgatgaagtcattgaagtgaatctaatcgatagtgccgactacatccacctggcctttctgaagagacctgagctcgggctcaccctcaccaagcttcactgttggactctcactcactacagcaagtgtgtcttcctggatgcagacactctggtgctgtccaatgtcgatgagctgtttgacaggggagagttttctgcggccccggaccccggatggccggattgcttcaatagcggggtgtttgtcttccagccttctctccacacgcataaactcctgctacagcacgccatggaacacggcagctttgacggggcagaccaaggcttactgaatagtttcttcaggaactggtcgaccacagacatccacaagcacctgccgttcatctataacttgagtagtaacacgatgtacacttacagccctgccttcaagcaattcggttccagtgcaaaggtcgtccactttttggggtccatgaaaccttggaactacaagtacaatccacagagtggctcggtgttggagcaaggctcagcgtccagcagccagcaccaggcggcattccttcatctctggtggacggtctaccagaacaacgtgctgcccctttataaaagcgtccaagcgggggaagcacgcgcgtctcctggtcacacactttgccacagtgatgtgggggggccgtgtgcggattcagcctctggtgttggagagccgtgtgaaaattcaacacccagtgcgggcgtgccgtgtgcaaattcaccactgggttctaaccagcctgctcagggccttccggagccgacccagatagtggatgagaccctgtccctacctgaaggacgccgttcagaagatgtcgacctggccgtctctgtttcccagatctccatcgaagagaaggtgaaggaattgagccccgaggaagagaggaggaagtgggaggaaggccgtatcgactacatggggaaggacgcgtttgctcgcatccaggagaagctggaccggttcctgcagtaatccggcagctggtgggcgttgtgtgtagttagacaatgtcctgttgggtggtcctgttgcgtggagatctcctctggtcctttcaaagggaaacgctgttgaaccttgtgcctctatttatgcttaatccatttgagtgcctcacacaaaaaacgtagagtatagaaatccaccttaaagcccctcgccccaacttctccaccaacgccttctgggctttcttcagaggtcacttctacccttgaagctgtcggcaaaagcgagcagtaataacattctagtagactctcgatggtggtctccgctcttgcccgaaggacctctgaagtacgctggagctgtgttgtacaggtgctgtgagacctaccctattcagaattaaacctcactgcaaatttcctcccatcacgaagctaacaacactaatatacgtatttagcacctctgaggctttgccatggagacccatttctgtagggctaaggaaacatttagacgtggtgactgactttcatttggacttggcgaagtgtatctgagaaacacctcggctgtggtctctctgctttaaatcctaacaggacttcctagagcgttgacagaaattctactcgtggacgttgggaagaaagattgtaggtggcttggggaatgtgggtggcttagaggatctaaaccgattcacttcctggttgagaagcaacgagggcttgctctaaatcgtttagaggataacaggatctagagatgctctctgcttgacaacaaaagtcagggtgcagtcggtccacccttgactgctcttggcttggtctctaccctcactacctcagttctcaataacttagtgaatcactgccctcctcaaagccatttccactcagctctttccagagaattctcagttttatgagacgggaaactttatttcacgagaaagcctcattgtcagaagtatcttcattcaatgggcacaatatgctgtgtatctcaccaggtagctgtcaggggccaccgagagtgtcgttaaaaatgggcatggttgtaataaaggaggaaagtgcgacttttgaaatgtttggaaggtttatttctcatgcacattccagggaaaagcagagagtaaattagagacgggataggaaggccgtgggagaactcgatcctagcctgtgtcagctggatgtgtttacgtggagaggcgtggccactttttaggtcacctgaagcagtttagcctttggatagaggaacctgcctgaatttatggcattagtggtggcatttttttgtgtacaagatgtgggtgatggaggggctgtttctttttccgtgtgggtggttaataatcgtcagtctcggagggcgaggctcgtaggatatttcaggtgagtcagggttggatggtcatcggctttcagaaggagaccacgggaatgttcagggaaacaatgtcagcttctctgaggaccagaattcatgttcacgggcagtgatgagttggcttatggagtgagtccagtctggaattccgccgtgcattctagcctgtatcatctcatttggacaaatgctggcacgttgaaattaaaatgtt

SEQ ID NO: 12569 - DNA, 751 bp, Homo sapiens
gcagttgtctttggtagtttttttgcactaacttcaggaaccagctcatgatctcaggatgtatggaaaaataatctttgtattactattgtcagatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgt

SEQ ID NO: 12570 - DNA, 2659 bp, Homo sapiens
gcaggaaggtgggcctggaagataacagctagcaggctaaggtcagacactgacacttgcagttgtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacacacacacacacaaacacacacatttatcatttaatgcataaatcaacacaaaaggttttcccattaatatgaaatattacatatatataagtgccatatttaaaataatttgtctaacagtagaactgtgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaattttaagagcattattaggttaattaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttattacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 12571 - DNA, 244 bp, Homo sapiens
gcagttgtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacttcttcttcagtcacaaagagttacatctcatcacagacaaatggagaaagggtacaacttgcccatcatttctctgaaccagactttcataat

SEQ ID NO: 12572 - DNA, 357 bp, Homo sapiens
atgtatggaaaaataatctttgtattactattgtcagaaattgtgagcatatcagcattaagtaccactgaggtggcaatgcacacttcaacttcttcttcagtcacaaagagttacatctcatcacagacaaatggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatga

SEQ ID NO: 12573 - DNA, 441 bp, Homo sapiens
atgtatggaaaaataatctttgtattactattgtcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccgagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtgga

SEQ ID NO: 12574 - DNA, 258 bp, Homo sapiens
atgtatggaaaaataatctttgtattactattgtcaggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatga

SEQ ID NO: 12575 - DNA, 622 bp, Homo sapiens
tttgcactaacttcaggaaccagctcatgatctcaggatgtatggaaaaataatctttgtattactattgtcaggagacggagccaaccctgaaaattctgggaaaagaggacagaaggcagagggaagagcaagagcaaaaattctgaaacagcagaaattgtgagcatatcagcattaagtaccactgaggtggcaatgcacacttcaacttcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataag

SEQ ID NO: 12576 - DNA, 527 bp, Homo sapiens
agttgtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgtt

SEQ ID NO: 12577 - DNA, 521 bp, Homo sapiens
gtctttggtagtttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccg

SEQ ID NO: 12578 - DNA, 360 bp, Homo sapiens
tttgcactaacttcaggaaccagctcatgatctcaggatgtatggaaaaataatctttgtattactattgtcaggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactat

SEQ ID NO: 12579 - DNA, 1246 bp, Homo sapiens
agtggcagatggaaagagaaacggttagaaaagcgtggttcttgcgcaggaaagttggagcaaagaagagttcagaagtgggcgggtgtgtgtttaaaaaaaaaaaagggggtggaaaccccaccagccaagtctgcagaaaaaaaataaatgaagtctgcctatctccgggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 12580 - DNA, 1072 bp, Homo sapiens
ggccagagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccg

SEQ ID NO: 12581 - DNA, 932 bp, Homo sapiens
cgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaac

SEQ ID NO: 12582 - DNA, 1684 bp, Homo sapiens
gtctttggtagtttttttgcactaacttcaggagccagctcgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctgaggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagttccacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtagatcaataaaacctctttcctttataaatt

SEQ ID NO: 12583 - DNA, 221 bp, Homo sapiens
agttgtctttggtagtttttttgcactaacttcaggagccagctcgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatggagaaaggggacaacttgtccatcgtttc

SEQ ID NO: 12584 - DNA, 499 bp, Homo sapiens
agttgtctttggtagtttttttgcactaacttcaggagccagctcgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggcatgaggatgtggcctgcatgctgcctgatcttgcctagaaccagctgcacctgctgttctcttgcttatgcaaactggctgcacctgctattcctttgcttatgccccaacccttggctatcctaactccctgttctcctgcctattactgtattctctacttctaaataaaaataaaacaaaatacaaattatt

SEQ ID NO: 12585 - DNA, 1624 bp, Homo sapiens
cgtgatctcaggatgtatggaaaaataatctttgtattactattgtcaggaattgtgagcatatcagcatcaagtaccactggtgtggcaatgcacacttcaacctcttcttcagtcacaaagagttacatctcatcacagacaaatggttgtgttattggtaacataatttgctctgacaaaagcaaataaaggaaattttagacctttattattcaactggataaaactgaaggttcagaagtgattgcaaatattgccaaccaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctgaggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagttccacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtag

SEQ ID NO: 12586 - DNA, 3402 bp, Homo sapiens
gcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcacccgacacagatgcagcaaatagggcatcacacatacacaggcattaatactcacgggcatatagatgctgacatgtgtacactgacttacgcccttcccacagctacagataaggcctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatttttgcatcgcttttgttttctttttatgtctctgaagccagcttttcctgttcactcatcccttgattaaatatggacattctagcttca

SEQ ID NO: 12587 - DNA, 1980 bp, Homo sapiens
attcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttc

SEQ ID NO: 12588 - DNA, 1989 bp, Homo sapiens
attcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttc

SEQ ID NO: 12589 - DNA, 3412 bp, Homo sapiens
gtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcacccgacacagatgcagcaaatagggcatcacacatacacaggcattaatactcacgggcatatagatgctgacatgtgtacactgacttacgcccttcccacagctacagataaggcctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatttttgcatcgcttttgttttctttttatgtctctgaagccagcttttcctgttcactcatcccttgattaaatatggacattctagcttc

SEQ ID NO: 12590 - DNA, 1925 bp, Homo sapiens
attatgaagattaaatgtgagaagtcaagaacgcaaagcagtgcccagcatgttcagcattcagcacacagcactattgtttgtaggaagcattcgcacaatgctgagacagctggaagggttgacattgtgaggggagggcccttctttcaccatcctttgcgtaaatggcttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgagatcacctagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaatagaatcaaggccaagctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactca

SEQ ID NO: 12591 - DNA, 2501 bp, Homo sapiens
gagagaaggacggagtcgagtggcaccctagaagacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccacctcagagcccgcccccagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgatagggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaaataattttagggttggga

SEQ ID NO: 12592 - DNA, 2339 bp, Homo sapiens
gacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgatagggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttc

SEQ ID NO: 12593 - DNA, 1553 bp, Homo sapiens
gtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctgg

SEQ ID NO: 12594 - DNA, 1230 bp, Homo sapiens
atgatcccttcccgccacacgatgctccgttttcttccggtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgtctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctga

SEQ ID NO: 12595 - DNA, 889 bp, Homo sapiens
cagctgtatcccatagagttgccacccaggcctcagccaggacctttcaggccagacaggagcacctgaccaaaggcttcacagccgccctcaccgcccggccttctacggtgtccagagacagttagccaggcctgggctgggcacactccaccttccctagtcaccagctggtttcccagaggagaaggctgagacccgagaagggagccagcctgtcccatgcctgcctggggagccctgttcctgctctgggccacagcagaggccaccaaggactgccccagcccatgtacctgccgcgccctggaaaccatggggctgtgggtggactgcaggggccacggactcacggccctgcctgccctgccggcccgcacccgccaccttctgctggccaacaacagccttcagtccgtgcccccgggagcctttgaccacctgccccagctgcagaccctcgatgtgacgcagaacccctggcactgtgactgcagcctcacctatctgcgcctctggctggaggaccgcacgcccgaggccctgctgcaggtccgctgtgccagccccagcctcgctgcccatggcccgctgggccggctgacaggctaccagctgggcagctgtggctggcagctgcaggcgtcctgggtgcgcccgggggtcttgtgggacgtggcgctggtcgccgtggccgcgctgggcctggctcttctggctggcctgctgtgtgccaccacagaggccctggattgagccaggcccccagaacccctggctccaggccagggggccagtccctgaggcaggtccccagactccaccaagcctggtcagcccaaaccaccagaagcccagaataaactggcagctcagctgttttatataa

SEQ ID NO: 12596 - DNA, 3275 bp, Homo sapiens
agaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaagtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggatttttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagtc

SEQ ID NO: 12597 - DNA, 1673 bp, Homo sapiens
cttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaagtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 12598 - DNA, 1830 bp, Homo sapiens
ggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 12599 - DNA, 1033 bp, Homo sapiens
gctcaggtggcgcctcctcggccacctctgcgacgaagccgggacgctggaggtgggaggggcgcggcgcaggtgtccggaacgcccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttg

SEQ ID NO: 12600 - DNA, 3957 bp, Homo sapiens
agcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataa

SEQ ID NO: 12601 - DNA, 678 bp, Homo sapiens
gaaagagagagagagagagagatcgagattgagatcttaagaaagagagcaaggaggaagagcccgactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggca

SEQ ID NO: 12602 - DNA, 1372 bp, Homo sapiens
cttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaagaacatttaaatgtggaaaagatctcaacgagccatttgtgaacagcagagctgaaatggaaattggcaggtaccactggatgtacccaggctcaaagaaccaccagtaccatcccgtgccaaccctgggggacagggctagccccttgagcagtccaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttcttta

SEQ ID NO: 12603 - DNA, 2268 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacaggaacctctgtgacccccagccggttaccaacagaaccaccttccccggtagcagaattctcagaagccaccgctgaactgaccgtctcattcacaaacgaagtcttcacaactgagacttctaggagtatcaccgccagtccaaaggagtcagactctccagctggtgagtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 12604 - DNA, 2210 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacagaattctcagaagccaccgctgaactgaccgtctcattcacaaacgaagtcttcacaactgagacttctaggagtatcaccgccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 12605 - DNA, 2264 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtacagggctagttttcccatcatcacggtgaccgccgcccacagcggaacctaccgatgctacagcttctccagcagggacccatacctgtggtcagcccccagcgaccccctggagcttgtggtcacaggaacctctgtgacccccagccggttaccaacagaaccaccttccccggtagcagaattctcagaagccaccgctgaactgaccgtctcattcacaaacgaagtcttcacaactgagacttctaggagtatcaccgccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgctgacccggaaatcaaacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcccgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcagggggctgaggtgggagaatggcttgagcctgggaggcagaggttgcagtgagctgagatcacaccactgcactctagctcgggtgacgaagcctgactttgtctcaaaaaatacagggatgaatatgtcaattaccctgatttgatcatagcacgttgtatacatgtactgcaatattgctgtccaccccataaatatgtacaattctgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagataaaaattgttttaaaa

SEQ ID NO: 12606 - DNA, 2078 bp, Homo sapiens
gtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 12607 - DNA, 1840 bp, Homo sapiens
gtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 12608 - DNA, 2281 bp, Homo sapiens
ccttcatcccacttaccgcagctccagagccctgcgggaggactcagagtcagggacacagcagcgtccggcgagatgaaggcgctcggggctgtcctgcttgccctcttgctgtgcgggcggccagggagagggcagacacagcaggaggaagaggaagaggacgaggaccacgggccagatgactacgacgaggaagatgaggatgaggtggaagaggaggagaccaacaggctccctggtggcaggagcagagtgctgctgcggtgctacacctgcaagtccctgcccagggacgagcgctgcaacctgacgcagaactgctcacatggccagacctgcacaaccctcattgcccacgggaacaccgagtcaggcctcctgaccacccactccacgtggtgcacagacagctgccagcccatcaccaagacggtggaggggacccaggtgaccatgacctgctgccagtccagcctgtgcaatgtcccaccctggcaaagctcccgagtccaggacccaacaggcaagggggcaggcggcccccggggcagctccgaaactgtgggcgcagccctcctgctcaacctccttgccggccttggagcaatgggggccaggagaccctgacccacggcccctccccacccccacccggctcacccccggccctgccagcactctgtctggtaccttcccctcctgcccctgcaccagctttggagaatggatttggagtgtcttgggcgatccagccagcgcaggccccccggcccggttgcttcctcagttcccggctgtgtccttggtgtcctttctccaccacctgtgagcagcaagactgccgcacgtgggcgctgggtccagacctcggctgccacgccccaggacctgcagccctcatgggggctggggatccccatcagcacagccaggcagagatgatacccaccacacacctgggggcccccacacccagtcctcacccttaacttctgccatgggaattcctccatctgcagcggtcacacgggcccaccctgcccttccccaggtcggcctctccgctgtctggagggaaggggatttggagggaggctgtcgtcgcccccaggaaagacgggcctgggggaggcgggacagtgggagaggcgcgctgaggatgagagggcacagggaggtgggttggggtgaggccacatgcggaggggcggggcgggggggggctggggggacaggcaccaagtatgaagaggatggggccagcggggcctgtctggctctggcgtgagcaccgctatgggagaccctggcttggaaagtgaacttgcagccttggatggggaagggccagatgctgggtgggtgcctgtcaccttgaggtgaccatctagggcagtacctgctgggcttaggacagcgcctgaggctgggaatacctgtctctgctctagcagaggctaaagcaggctagagcagtggaggggtggagttgatgaaaggagaggagtagatgagatggaatttttccagcctcatcctggcctgccctctagactccagtccccaagccctcagcctagtgggtgtcatggatggatctgggggtgtcagacaggctaccctgtgccagggagggggcagaatgggcctgcagcttcctgcagaggaagcaggactgggtagcagagccgggaaggtgggtggcccattacaggggggtccccagggtgtcctctggcagggctgtgactgctgcaagctctgccttcaccagtagctggtgccaggacagagctctgggacagcaggcagaggccgagcctgggccacagctcagccactgacttgggtatcagtttccccttctgagaagtacagagtgagacttaaagaacccctagatccccaccagttcaacactccattaactgggaagcccagagtcctgtccggcctgccaagttcatcctggtggacagcgggaggcctccgctaactgttctcttcttttccttattaataaaacacacaatgcctagctggggggtcggaaggcaaatgccctagatggtggggtcacgtctttctccttctccttcctccttctgctggctgaagtgatgactggagctcagcaaccactttgcaccatgaggcagcactgagcacggtagggcagcctggtgagaggggcctagctcgctgccgacagaagtcactgcctacctcagggtccccttacctgggtgggaaataaatttctgctgtgttgaagcta

SEQ ID NO: 12609 - DNA, 723 bp, Homo sapiens
gtcggcgcgggaggctcagatggctggaggcggcgggcacgcacactgcggggctccgaggggcacaggtccaggctcctgcgtgaagtgatgctcctctttgccttactcctagccatggagctcccattggtggcagccagtgccaccatgcgcgctcagtggacttacagtttgagatgccatgactgtgcggtcataaatgacttcaactgtcccaacattagagtatgtccgtatcatattaggcgctgtatgacaatctccattcgcataaattctcgtgaactacttgtttataagaactgtacaaacaactgcacatttgtatatgcagctgaacagcctcctgaagccccaggaaaaatcttcaaaactaatagcttctactgggtttgttgttgtaatagcatggtttgcaatgcaggaggacctactaatcttgaaagggacatgttacccgatgaagtaactgaggaggagcttccagaaggaactgtgaggctgggggtatcaaaactgttgctgagttttgcctctatcatagtcagcaatatattgccatgaggaccccaccttggagggtctgaccatcttcacctgttccgcagagaaatgttgctctccattattcccttctaagccagagacccttatccactgctcctctaggtggcccatttatggtttgttgtaagagaaaaattaaaaaaatattgttta

SEQ ID NO: 12610 - DNA, 3489 bp, Homo sapiens
gtgacctgcttagagagaagcggtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcacatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccaatggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatac

SEQ ID NO: 12611 - DNA, 1090 bp, Homo sapiens
agtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggtactgtttatttacatttgctaaattttctcgtggtatagttcacttataatgacatcactactgtgctttaaatatgtgtgtctttaatattttgctggttgcatgtattttctatttaatgttgcagttcatttagagtagagatgtacctcatttaacatagagatgtatttctaaaaacttgtgtctatatgtatttttttgttaaaaaattctacactttgttgttgacatgtcataattttagaaaaactttacttatacattgggttaaaattcattagctagtgtctcctactttcctaatactttagctttaaactagtaaactccaccttttgcctgtagtagtaaattgcttttaaatatttaaactaggtggtgaatggtgtttattaaacccttatggtcgatatttccttaaagtaaaacaaaaaacacctttggttatatggccagttctttcttaatttatatgtttcactaactaagatttttaaaagataattttttcttaaaaaaaaaaaaaaaaaaaaa

SEQ ID NO: 12612 - DNA, 1526 bp, Homo sapiens
attctcctagatcaagaagacttcctcatcaagacctcattctatttgcacagccctgcagtggagagatttattgcgtttctttcatgcaatcaacgcagactttgatgtgaacacggggagagacagtgcacgtgcagctgacccacggggaacagtcagccccgggcacttgaaggagaacagaggcttccctaactcaagtcgctgtctcctgccagctgaacattctagaagcaacctctaaggagagaatgaattctaaaagaatgctgttattggttttatttgctttttcactgatgttggttgagcgttatttcaggaatcaccaagtagaagaacttcggctctcagactggtttcatcctagaaaacgccctgatgttataacgaaaacagactggctcgctcctgtcctatgggaagggactttcgacaggcgggtcctggaaaaacattacagaaggcggaatatcactgtgggcctggccgtctttgctactggcaggtttgcagaggagtacctgaggccgttcctacactccgcaaataagcacttcatgacaggctaccgagtgatcttctacatcatggtggacgccttcttcaagctgcctgacatagagcccagtcctcttcgaacgttcaaagcatttaaagtgggcaccgagaggtggtggctcgatggccccctggtgcatgtgaagagcctgggtgaacacatcgccagtcacatccaggacgaggtggacttcctcttcagcatggctgccaaccaggtcttccagaatgagttcggggtggagaccctgggcccgttggtggcccagctccacgcctggtggtatttcagaaacaccaagaacttcccttatgagaggaggccgacctcagcagcttgcatcccgtttggacagggagatttctattatggcaacttgatggttggtggcacaccccataatattttagacttcatcaaagaatatctgaacggagttattcatgacatcaaaaatggactcaatagcacttatgaaaagcaccttaacaaatatttttacctcaataaacccacctagctgttatcaccagcatacagctgggatcttgcattttctcctcctccacagatccaatacgtcaaggtcgcacatgattcccagaggaaattatgaattacgccatgaggtttatgacgaataaatgaatcacggcaatttcttataaatgagggaagtcttaagaccttccattttttagagacatacaaatttacatccttcccaaataaatgtttcttcttgccattttgagccatcttatttggctaatgtaggataaagaataaaaggataattacttaatgttaatacacagtaatgttattatctatgtattgtagacaatgtgaaaatacatttgacatagaatgaatatttttaatggagaaagactctagttgagaaaaaacattcataaaatggaaaagtagttcacgcaaaggaaaaaataaatgccag

SEQ ID NO: 12613 - DNA, 2522 bp, Homo sapiens
gccgcccagggctgagtctcccatctcgcccctcggtccgcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 12614 - DNA, 1788 bp, Homo sapiens
gcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggaggccagggccggcttcaacagcagctccacctgtggttgtgcccacccgtcgcatcaggcaagatggcccatggtggtctag

SEQ ID NO: 12615 - DNA, 2516 bp, Homo sapiens
gcgagcgcagggcccagcccgggagccgctggagcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 12616 - DNA, 2528 bp, Homo sapiens
gagtgctagccagccctgggaggctccgctgccagaaggaacgtcaaggggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcggtggggacctggggtgtgagcgccgcgagcctggcgggcgagcgggggccccgggatgcttccccggcccgctcatgccacgtgtccccccagacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 12617 - DNA, 2429 bp, Homo sapiens
gccgcccagggctgagtctcccatctcgcccctcggtccgcagggcctgcgatggagcctgcagccccgggtcgcgtccctccctgagcgcccccgtcggcggccatgctgccccgagggcgcccccgggcgctgggggccgccgcgctgttgctgctgctgctgctgctcggattcctcctgttcgacgggaggctgcggagagccgccgccctcgacggagacccgggggccggccccggggaccacaaccgctccgactgcggcccgcagccgccgccgccgcccaagtgcgagctcttgcatgtggccatcgtgtgtgcggggcataactccagccgagacgtcatcaccctggtgaagtccatgctcttctacaggaaaaatccactgcacctccacttggtgactgacgccgtggccagaaacatcctggagacgctcttccacacatggatggtgcctgctgtccgtgtcagcttttatcatgccgaccagctcaagccccaggtctcctggatccccaacaagcactactccggcctctatgggctaatgaagctggtgctgcccagtgccttgcctgctgagctggcccgcgtcattgtcctggacacggatgtcaccttcgcctctgacatctcggagctctgggccctctttgctcacttttctgacacgcaggcgatcggtcttgtggagaaccagagtgactggtacctgggcaacctctggaagaaccacaggccctggcctgccttgggccggggatttaacacaggtgtgatcctgctgcggctggaccggctccggcaggctggctgggagcagatgtggaggctgacagccaggcgggagctccttagcctgcctgccacctcactggctgaccaggacatcttcaacgctgtgatcaaggagcacccggggctagtgcagcgtctgccttgtgtctggaatgtgcagctgtcagatcacacactggccgagcgctgctactctgaggcgtctgacctcaaggtgatccactggaactcaccaaagaagcttcgggtgaagaacaagcatgtggaattcttccgcaatttctacctgaccttcctggagtacgatgggaacctgctgcggagagagctctttgtgtgccccagccagcccccacctggtgctgagcagttgcagcaggccctggcacaactggacgaggaagacccctgctttgagttccggcagcagcagctcactgtgcaccgtgtgcatgtcactttcctgccccatgaaccgccacccccccggcctcacgatgtcacccttgtggcccagctgtccatggaccggctgcagatgttggaagccctgtgcaggcactggcctggccccatgagcctggccttgtacctgacagacgcagaagctcagcagttcctgcatttcgtcgaggcctcaccagtgcttgctgcccggcaggacgtggcctaccatgtggtgtaccgtgaggggcccctataccccgtcaaccagcttcgcaacgtggccttggcccaggccctcacgccttacgtcttcctcagtgacattgacttcctgcctgcctattctctctacgactacctcagggcctccattgagcagctggggctgggcagccggcgcaaggcagcactggtggtgccggcattcgagaccctgcgctaccgcttcagcttcccccattccaaggtggagctgttggccttgctggatgcgggcactctctacaccttcaggtaccacgagtggccccgaggccacgcacccacagactatgcccgctggcgggaggctcaggccccgtaccgtgtgcaatgggcggccaactatgaaccctacgtggtggtgccacgagactgtccccgctatgatcctcgctttgtgggcttcggctggaacaaagtggcccacattgtggagctggatgcccaggaatatgagctcctggtgctgcccgaggccttcaccatccatctgccccacgctccaagcctggacatctcccgcttccgctccagccccacctatcgtgactgcctccaggccctcaaggacgaattccaccaggacttgtcccgccaccatggggctgctgccctcaaatacctcccagccctgcagcagccccagagccctgcccgaggctgaggctgggccggcgctgcccctcatcttagcattgggcagacaccagggcaacctgccctccgccatccctgctatttaaattatttaaggtctctgggaagggctggggcagagcatctgtggggtggggtcttccccttgctgctattgtatggctggggactggtctctctctgccccagccagtttggggctggttcccccatcttgaattgtttatccctttttcataattaaagttttaaaacatc

SEQ ID NO: 12618 - DNA, 2404 bp, Homo sapiens
gggcacggcgtcagcgcgtcgccggctgggccgcgccggtggccaggagggagagacaaggaggaggaggaggaggaggtatctctgcattagccagattggacatatgtaaagggacatcagtatatctggatcatcaggaatcatctttcttccagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 12619 - DNA, 2607 bp, Homo sapiens
atatggttgtctgagagcatcagaaaagaacctgctctggtcaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 12620 - DNA, 2408 bp, Homo sapiens
aggtctggctagctgtccctaacgtcatttcctggtctcaactctttaagaccctgacatactctgagattggagtgaagatttctgtgacatgctgggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaa

SEQ ID NO: 12621 - DNA, 2828 bp, Homo sapiens
caggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaattagcatattcatttacatatagatgtatacatctacctatgtgtttctcactgaacgttttccttgtgacagagacaacaaatacaattgtttcttttccggatgaacaaggatctgttttgcaaatgtttgtaagatattatgacatttccaagattttctttgcattctggaaagcaggaggtaaacatttgtagtcattaaggtaaagtctgttgataaaccatcttctgtttactgacaggtaaattgtaacttt

SEQ ID NO: 12622 - DNA, 2954 bp, Homo sapiens
ggacttgctggagatatagaaagggacctgacacagtttctggccttaaggagctctcattccagtggggaagaaaaaaactaaaataatgatgtccgagagcatcagaaaagaacctgctctggtcaggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaattagcatattcatttacatatagatgtatacatctacctatgtgtttctcactgaacgttttccttgtgacagagacaacaaatacaattgtttcttttccggatgaacaaggatctgttttgcaaatgtttgtaagatattatgacatttccaagattttctttgcattctggaaagcaggaggtaaacatttgtagtcattaaggtaaagtctgttgataaaccatcttctgtttactgacaggtaaattgtaacttt

SEQ ID NO: 12623 - DNA, 601 bp, Homo sapiens
aggtgacactgatgataaaaatccatccaagaatttatatgtgacatctgcagcaggttcaaatctctcagctatgagacaaactggatacttcctaaggattgccatctattatgcacagagagccaaaatccgttactgaaattgtctgggtatctctgcattagccagattggacatatgtaaagggacatcagtatatctggatcatcagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaa

SEQ ID NO: 12624 - DNA, 753 bp, Homo sapiens
gtatctctgcattagccagattggacatatgtaaagggacatcagtatatctggatcatcagtggtataatgtgttatagaggtggacaagcctgcagattgaagtggggatcgtccagattgttcccttccctggaccatatgattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcag

SEQ ID NO: 12625 - DNA, 2659 bp, Homo sapiens
gggcacggcgtcagcgcgtcgccggctgggccgcgccggtggccaggagggagagacaaggaggaggaggaggaggaggtatctctgcattagccagattggacatatgtaaagggacatcagtatatctggatcatcaggaatcatctttcttccagattgtgcttcaagaagaccatagggaagaacgcattttcatcttgctgcaaaagttgcaatagaagatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatgcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaattttt

SEQ ID NO: 12626 - DNA, 2634 bp, Homo sapiens
gcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagcacgcgcgccgcgtcgtttacgcggcgatttcatcatgctccgagccgggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctgctccgccggtccctcagcgcggcctcctgccccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaaaactactcttatgtccactttacaaaagaaaacagcattgtgattactcccagggaccgtattttatcttcagtggctgcctgattttacccccacaattaaagttgaaggaatcctgaacaaa

SEQ ID NO: 12627 - DNA, 1994 bp, Homo sapiens
ctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgagacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataaga

SEQ ID NO: 12628 - DNA, 1280 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgaga

SEQ ID NO: 12629 - DNA, 2187 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcatgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgac

SEQ ID NO: 12630 - DNA, 1590 bp, Homo sapiens
ttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcccttgtgaaaacctctccagttctcagaggttaggaaaaacctgagtggctttccagatggcttggaccatgtgaggacagcatcagccagtcacagcctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccagaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatgaaggtgtgattctctgaggaaagagtgattctgatatatgtacttgtcacattggtgttggacacatttgcgccaaaagtatggtaattctattattaaataattctctg

SEQ ID NO: 12631 - DNA, 3711 bp, Homo sapiens
gggactgcgctagcccgccgcgctctgggctgcccgagcgagcgttcggacctcgcaccccgcgcgccccgcgccgccgccgccgccggcttttgttgtctccgcctcctcggccgccgccgcctctggaccgcgagccgcgcgcgccgggaccttggctctgcccttcgcgggcgggaactgcgcaggacccggccaggatccgagagaggcgcgggcgggtggccgggggcgccgccggccccgccatggagctccgggcccgaggctggtggctgctatgtgcggccgcagcgctggtcgcctgcgcccgcggggacccggccagcaagagccggagctgcggcgaggtccgccagatctacggagccaagggcttcagcctgagcgacgtgccccaggcggagatctcgggtgagcacctgcggatctgtccccagggctacacctgctgcaccagcgagatggaggagaacctggccaaccgcagccatgccgagctggagaccgcgctccgggacagcagccgcgtcctgcaggccatgcttgccacccagctgcgcagcttcgatgaccacttccagcacctgctgaacgactcggagcggacgctgcaggccaccttccccggcgccttcggagagctgtacacgcagaacgcgagggccttccgggacctgtactcagagctgcgcctgtactaccgcggtgccaacctgcacctggaggagacgctggccgagttctgggcccgcctgctcgagcgcctcttcaagcagctgcacccccagctgctgctgcctgatgactacctggactgcctgggcaagcaggccgaggcgctgcggcccttcggggaggccccgagagagctgcgcctgcgggccacccgtgccttcgtggctgctcgctcctttgtgcagggcctgggcgtggccagcgacgtggtccggaaagtggctcaggtccccctgggcccggagtgctcgagagctgtcatgaagctggtctactgtgctcactgcctgggagtccccggcgccaggccctgccctgactattgccgaaatgtgctcaagggctgccttgccaaccaggccgacctggacgccgagtggaggaacctcctggactccatggtgctcatcaccgacaagttctggggtacatcgggtgtggagagtgtcatcggcagcgtgcacacgtggctggcggaggccatcaacgccctccaggacaacagggacacgctcacggccaaggtcatccagggctgcgggaaccccaaggtcaacccccagggccccgggcctgaggagaagcggcgccggggcaagctggccccgcgggagaggccaccttcaggcacgctggagaagctggtctccgaagccaaggcccagctccgcgacgtccaggacttctggatcagcctcccagggacactgtgcagtgagaagatggccctgagcactgccagtgatgaccgctgctggaacgggatggccagaggccggtacctccccgaggtcatgggtgacggcctggccaaccagatcaacaaccccgaggtggaggtggacatcaccaagccggacatgaccatccggcagcagatcatgcagctgaagatcatgaccaaccggctgcgcagcgcctacaacggcaacgacgtggacttccaggacgccagtgacgacggcagcggctcgggcagcggtgatggctgtctggatgacctctgcagccggaaggtcagcaggaagagctccagctcccggacgcccttgacccatgccctcccaggcctgtcagagcaggaaggacagaagacctcggctgccagctgcccccagcccccgaccttcctcctgcccctcctcctcttcctggcccttacagtagccaggccccggtggcggtaactgccccaaggccccagggacagaggccaaggactgactttgccaaaaatacaacacagacgatatttaattcacctcagcctggagaggcctggggtgggacagggagggccggcggctctgagcaggggcaggcgcagaggtcccagccccaggcctggcctcgcctgcctttctgccttttaattttgtatgaggtcctcaggtcagctgggagccagtgtgcccaaaagccatgtatttcagggacctcaggggcacctccggctgcctagccctccccccagctccctgcaccgccgcagaagcagcccctcgaggcctacagaggaggcctcaaagcaacccgctggagcccacagcgagcctgtgccttcctccccgcctcctcccactgggactcccagcagagcccaccagccagccctggcccaccccccagcctccagagaagccccgcacgggctgtctgggtgtccgccatccagggtctggcagagcctctgagatgatgcatgatgccctcccctcagcgcaggctgcagagcccggccccacctccctgcgcccttgaggggccccagcgtctgcagggtgacgcctgagacagcaccactgctgaggagtctgaggactgtcctcccacagacctgcagtgaggggccctccatgcgcagatgaggggccactgacccacctgcgcttctgctggaggaggggaagctgggcccaaaggcccagggaggcagcgtgggctctgccaatgtgggctgcccctcgcacacagggctcacagggcaggccttgctggggtccagggctgttggaggaccccgagggctgaggagcagccaggacccgcctgctcccatcctcacccagatcaggaaccagggcctccctgttcacggtgacacaggtcagggctcagagtgaccctcagctgtcacctgctcacagggatgctggtggctggtgagaccccgcactgcagacgggaatgcctaggtcccttcccgacccagccagctgcagggcacggggacctggatagttaagggcttttccaaacatgcatccatttactgacacttcctgtccttgttcatggagagctgttcgctcctcccagatggcttcggagggccgcagggcccaccttggaccctggtgacctcctgtcactcactgaggccatcagggccctgccccaggcctggacgggccctccttccctcctgtgccccagctgccaggcggccctggggaggggtggtgtggtgttgggaaggggtcctgcagggggaggaggacttggagggtctgggggcagctgtcctgaaccgactgaccctgaggaggccgcttagtgctgctttgcttttcatcaccgtcccgcacagtggacggaggtccccggttgctggtcaggtccccatggcttgttctctggaacctgactttagatgttttgggatcaggagcccccaacacaggcaagtccaccccataataaccctgccagtgccagggtgggctggggactctggcacagtgatgccgggcgccaggacagcagcactcccgctgcacacagacggcctaggggtggcgctcagaccccaccctacgctcatctctggaaggggcagccctgagtggtcactggtcagggcagtggccaagcctgctgtgtccttcctccacaaggtccccccaccgctcagtgtcagcgggtgacgtgtgttcttttgagtccttgtatgaataaaaggctggaaaccta

SEQ ID NO: 12632 - DNA, 2568 bp, Homo sapiens
cgccctgtgtagagcggctgcgagcgggcagctgggctcggctgccgggagccaccgcgcgggctccgcaccctcctctcgcactgccttcgcccggtccccgcgccgcggtgccccagtggcccccgccgcgctccacgccgcgcccccgcaccccgccggctaccggccgcacaaccgccaccgccccctggccgcgcggctcgcctcgccccgccccgtccctcctcgccccgccccaccccagtcagccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaa

SEQ ID NO: 12633 - DNA, 2379 bp, Homo sapiens
agccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgaaactgagaagaaaatatggcacttcaaatatcctatcttcttcctgtgtatagggctagacttacagattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctc

SEQ ID NO: 12634 - DNA, 836 bp, Homo sapiens
ttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcaggtaactgattagtgctgacccaaatgtaatctaaaaatggtgatgctcaggaattaaaaataaattgaacccgc

SEQ ID NO: 12635 - DNA, 1581 bp, Homo sapiens
atggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactga

SEQ ID NO: 12636 - DNA, 4960 bp, Homo sapiens
cagtcaatcagcggcagagctgagaagggcacagccgcgcggcggagggcagagtcagccgagccgagtccagccggacgagcggaccagcgcagggcagcccaagcagcgcgcagcgaacgcccgccgccgcccacaccctctgcggtccccgcggcgcctgccacccttccctccttccccgcgtccccgcctcgccggccagtcagcttgccgggttcgctgccccgcgaaaccccgaggtcaccagcccgcgcctctgcttccctgggccgcgcgccgcctccacgccctccttctcccctggcccggcgcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattctggctggtgtgtataagtggttttttttttaaaacaaatcagaagacataaaattgaaaaggcactccatttatatataagggaaaatagattgtaaatagctaaggggccttgtgagaacttggaaaatgtgctgatacttagtaactacctcagttgtgaggaatttcctttttagcttagactgctattacttttacttggtagaaatgaatctggtctccaaaatatggctcagagagttatccccatagaccttgttagattgtttttaatttaaaaccttgaactctgcccagctgttttcttccagtcaaattctctaaaccaataacattttccaaattaagtattcttgaaggttcttctgaactcttactgatttgttttctttctttgcattttttcctgttactcttttattatttaaattgtctcttgcttttgaacttcaactatgaaataaacaaatcatagatttttccattcaggtctgactggataactcttggcttctaagcagctggcaagctcacccccactccccaaaaaagaagaaaggcaagttgaatattttaaaaccttaagagtttggagtatgaagtagaataaaagccttgttaggagaagacctgacttttccaaagttaacagcatgtgaagggcttgtgttttacaaagtcatttataaattatttttctttaaaacacatcacctactctgtaccttaaagattttacaactcttagatttatattttatttcaaaaatcgtaactagcacctgttattttgattaaaagacactgcgaagaattgacgtaaatttctaaagtttagttactgagtgttcaaaacctaacagttcacatgaagtaaaaattgtcatttgtgattacagaatcaaaataaaaataggtatgaatggtgcta

SEQ ID NO: 12637 - DNA, 1835 bp, Homo sapiens
agtgcgactgtcgcgctccgctccccgcctccgctcctcctctcccccctgcattattcgccgtcccgggaagcccctgaggactgtggccctcaaagtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgt

SEQ ID NO: 12638 - DNA, 3696 bp, Homo sapiens
gcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgcgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatgaagatctgtccccagggttctacctgctgctctcaagagatggaggatacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtgccttcatgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggagaaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagccaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttcttttttttaaattattattaagacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatctccatttgttttgggatcccagtttttgttttaagagagtataaggtgtctcatttgagtctttttcttacctagccccctcttatcagtaaaacaaaggacttgccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacatttcattcaactttttacaccaaattctgcagagtggtcaaaatggaatattgggggctgttgtaaacagaggcttaattttattagaagtagccagttatttattaaagcatgatgttaataaaataggcatattc

SEQ ID NO: 12639 - DNA, 2889 bp, Homo sapiens
ggcagtggcggcagtggcggcagtggcggcagcggcagcagttgcagcagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggacctgatcttcaggtttgcatatccaaaaagcctacatgttgcaccaggaagatggaggagagatatcagattgcggctcgccaggatatgcagcagtttcttcaaacgtccagctctacattaaagtttctaatatctcgaaatgcggctgcttttcaagaaacccttgaaactctcatcaaacaagcagaaaattacaccagtatacttttttgcagtacctacaggaacatggccttggaggctgctgcttcggttcaggagttcttcactgatgtggggctgtatttatttggtgcggatgttaatcctgaagaatttgtaaacagattttttgacagtctttttcctctggtctacaaccacctcattaaccctggtgtgactgacagttccctggaatactcagaatgcatccggatggctcgccgggatgtgagtccatttggtaatattccccaaagagtaatgggacagatggggaggtccctgctgcccagccgcacttttctgcaggcactcaatctgggcattgaagtcatcaacaccacagactatctgcacttctccaaagagtgcagcagagccctcctgaagatgcaatactgcccgcactgccaaggcctggcgctcactaagccttgtatgggatactgcctcaatgtcatgcgaggctgcctggcgcacatggcggagcttaatccacactggcatgcatatatccggtcgttggaagaactctcggatgcaatgcatggaacatacgacattggacacgtgctgctgaactttcacttgcttgttaatgatgctgtgttacaggctcacctcaatggacaaaaattattggaacaggtaaataggatttgtggccgccctgtaagaacacccacacaaagcccccgttgttcttttgatcagagcaaagagaagcatggaatgaagaccaccacaaggaacagtgaagagacgcttgccaacagaagaaaagaatttatcaacagccttcgactgtacaggtcattctatggaggtctagctgatcagctttgtgctaatgaattagctgctgcagatggacttccctgctggaatggagaagatatagtaaaaagttatactcagcgtgtggttggaaatggaatcaaagcccagtctggaaatcctgaagtcaaagtcaaaggaattgatcctgtgataaatcagattattgataaactgaagcatgttgttcagttgttacagggtagatcacccaaacctgacaagtgggaacttcttcagctgggcagtggtggaggcatggttgaacaagtcagtggggactgtgatgatgaagatggttgcgggggatcaggaagtggagaagtcaagaggacactgaagatcacagactggatgccagatgatatgaacttcagtgatgtaaagcaaatccatcaaacagacactggcagtactttagacacaacaggagcaggatgtgcagtggcgactgaatctatgacattcactctgataagtgtggtgatgttacttcccgggatttggtaactgaactcttctgtcctgacataccttactgaagtctcgatttcttctctctctgcatatgcctggaataagagatcctttttcaatgtaacaattatatttatgaaaagatatgttacactaacttctcagaagccaagctgaaatattcataaagtccctaaaactcaacgtttaaatgacacactttaaaaatatgtcttttttcaatctaactgaaaaccttcttaacttctaatatattaaatctgaagatgtgaagggcacagaagtgactttgaataagaagaatttagtgtatctgtaattttattatcaattccaagccccttcctttctaaattaaaaatgttttcatttgaaagtgtatttgccagacaatgaaaacagtatgcagtatttcttaaagtattgaaattagaatatcatgaaataaatcaaaacatacaatggcaagtagtatgcatgcatattcaagagactcttccatttttgcaagctgtagaaggaaatgtctgaatgtctataagttatggggtagattcttgagaagcatttcatataatttcactgaagaaccttgataattttgacccactgtaacttagccactgatgaaccttaaagctgagtattttattaacacctgatttgtattccattatattcaaaatgcatctttggtattgtgcctctgctcccatctctctctttgcctcatagatttagctatgttgggaagcacatgcttgctctaggaatatctccaataaagctgttaactatttggtggaaaaa

SEQ ID NO: 12640 - DNA, 2624 bp, Homo sapiens
ccaggatttctctcttcctatttcaggaggactctcacaggctcccacagcctgtgttaagctgaggtttcccctagatctcgtatatccccaacacatacctccacgcacacacatccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggggaacacttaagaatctgtcctcaggaatatacatgctgcaccacagaaatggaagacaagttaagccaacaaagcaaactcgaatttgaaaaccttgtggaagagacaagccattttgtgcgcaccacttttgtgtccaggcataagaaatttgacgaatttttccgagagctcctggagaatgcagaaaagtcactaaatgatatgtttgtacggacctatggcatgctgtacatgcagaattcagaagtcttccaggacctcttcacagagctgaaaaggtactacactgggggtaatgtgaatctggaggaaatgctcaatgacttttgggctcggctcctggaacggatgtttcagctgataaaccctcagtatcacttcagtgaagactacctggaatgtgtgagcaaatacactgaccagctcaagccatttggagacgtgccccggaaactgaagattcaggttacccgcgccttcattgctgccaggacctttgtccaggggctgactgtgggcagagaagttgcaaaccgagtttccaaggtcagcccaaccccagggtgtatccgtgccctcatgaagatgctgtactgcccatactgtcgggggcttcccactgtgaggccctgcaacaactactgtctcaacgtcatgaagggctgcttggcaaatcaggctgacctcgacacagagtggaatctgtttatagatgcaatgctcttggtggcagagcgactggaggggccattcaacattgagtcggtcatggacccgatagatgtcaagatttctgaagccattatgaacatgcaagaaaacagcatgcaggtgtctgcaaaggtctttcagggatgtggtcagcccaaacctgctccagccctcagatctgcccgctcagctcctgaaaattttaatacacgtttcaggccctacaatcctgaggaaagaccaacaactgctgcaggcacaagcttggaccggctggtcacagacataaaagagaaattgaagctctctaaaaaggtctggtcagcattaccctacactatctgcaaggacgagagcgtgacagcgggcacgtccaacgaggaggaatgctggaacgggcacagcaaagccagatacttgcctgagatcatgaatgatgggctcaccaaccagatcaacaatcccgaggtggatgtggacatcactcggcctgacactttcatcagacagcagattatggctctccgtgtgatgaccaacaaactaaaaaacgcctacaatggcaatgatgtcaatttccaggacacaagtgatgaatccagtggctcagggagtggcagtgggtgcatggatgacgtgtgtcccacggagtttgagtttgtcaccacagaggcccccgcagtggatcccgaccggagagaggtggactcttctgcagcccagcgtggccactccctgctctcctggtctctcacctgcattgtcctggcactgcagagactgtgcagataatcttgggtttttggtcagatgaaactgcattttagctatctgaatggccaactcacttcttttcttacactcttggacaatggaccatgccacaaaaacttaccgttttctatgagaagagagcagtaatgcaatctgcctccctttttgttttcccaaagagtaccgggtgccagactgaactgcttcctctttccttcagctatctgtggggaccttgtttattctagagagaattcttactcaaatttttcgtaccaggagattttcttaccttcatttgcttttatgctgcagaagtaaaggaatctcacgttgtgagggttttttttttctcattt

SEQ ID NO: 12641 - DNA, 3896 bp, Homo sapiens
gtgctaagctcccttccgttccagccgccttcagccccgccgcgctcagttccgcccctttctcttccaactccgcctacgccccagagagggaaggccttgacacctacgctagagagacaggctccaatgaaaagagcgagggggcggagccgggaggaatcggtccaattctcggccgggaagtctctggccgggacggggcagggcgaacctgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggacagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaa

SEQ ID NO: 12642 - DNA, 1866 bp, Homo sapiens
gggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagatgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12643 - DNA, 1642 bp, Homo sapiens
cagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagc

SEQ ID NO: 12644 - DNA, 2578 bp, Homo sapiens
agaacctcactgcccgtccctcctcgcctcagtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccactctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12645 - DNA, 1975 bp, Homo sapiens
tcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12646 - DNA, 2551 bp, Homo sapiens
agtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccactctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12647 - DNA, 840 bp, Homo sapiens
atgggctgcctcgggaacagtaagaccgaggaccagcgcaacgaggagaaggcgcagcgtgaggccaacaaggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagc

SEQ ID NO: 12648 - DNA, 1972 bp, Homo sapiens
tcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12649 - DNA, 1931 bp, Homo sapiens
ctcgccgccgccgcctcctcctccccccgcctccccccgcccgccgcggcgcttttggctcggggcggcggcgggggcccggccgaggcaataagagcggcggcggcggcagcggcggcagcagctcccgcagctcctgctctggtccgcctcggcccggcggcggccatcagccccctcggcctcggctcgaggggcggggagctgcgcgcgcccctcggtccgaccgacaccctccccttcccgcccgtccgcgcgccccgcggcccgcggcccgcagtccgccccgcgcgctccttgccgaggagccgagcccgcgcccggcccgcccgcccggcgctgccccggccctcccggcccgcgtgaggccgcccgcgcccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12650 - DNA, 1719 bp, Homo sapiens
agtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccactctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggaatataatatccctagatgatggctacagtttctcatcttcccggctatgtcctatcacaatttgcatgctggaattgctcggtcttaggaacttctaataagaatactattctgttatctgaggggggaggggggatggggcccctgctacctgaccttaaacgatgattgaaaaaacgaaaaatgaactgaaatccttaattggcagaaatgtagtatgacaactatccaaaaaggcatctctataagaaatgactaattgacaatctgctgtaccaaaagttggcatttgagcaagatatgacaagtccttagtgagcaacctactgtgtactagatgtcctgctaaacccttgaaccctactaataccttggcctgcacgtctctctcactctgttctgcaagtcaatataagtattaacattcgtgataaataaaaattctctgcatgtttcagcaa

SEQ ID NO: 12651 - DNA, 3480 bp, Homo sapiens
gttatgggcgtgcgcaactgcctctacggcaataatatgtcaggacaacgcgatatcccccctgaaatcggggaacagcccgagcaaccacctttggaggccccaggggcagctgcccccggtgctgggcctagcccagccgaagagatggagaccgaaccgcctcacaacgagcccatccccgtcgagaatgatggcgaggcctgtggacccccagaggtctccagacccaactttcaggtcctcaacccggcattcagggaagctggagcccatggaagctacagcccacctcctgaggaagcaatgcccttcgaggctgaacagcccagcttgggaggcttctggcctacactggagcagcctggattccccagtggggtccatgcaggccttgaggccttcggcccagcactcatggagcccggagccttcagtggtgccagaccaggcctgggaggatacagccctccaccagaagaagctatgccctttgagtttgaccagcctgcccagagaggctgcagtcaacttctcttacaggtcccagaccttgctccaggaggcccaggtgctgcaggggtccccggagctcctcccgaggagccccaagccctcaggcctgcaaaggctggctccagaggaggctacagccctccccctgaggagactatgccatttgagcttgatggagaaggatttggggacgacagcccacccccggggctttcccgagttatcgcacaagtcgacggcagcagccagttcgcggcagtcgcggcctcgagtgcggtccgcctcactcccgccgcgaacgcgcctcccctctgggtcccaggcgccatcggcagcccatcccaagaggctgtcagacctccttctaacttcacgggcagcagcccctggatggagatctccggacccccgttcgagattggcagcgcccccgctggggtcgacgacactcccgtcaacatggacagccccccaatcgcgcttgacggcccgcccatcaaggtctccggagccccagataagagagagcgagcagagagacccccagttgaggaggaagcagcagagatggaaggagccgctgatgccgcggagggaggaaaagtaccctctccggggtacggatcccctgccgccggggcagcctcagcggataccgctgccagggcagcccctgcagccccagccgatcctgactccggggcaaccccagaagatcccgactccgggacagcaccagccgatcctgactccggggcattcgcagccgatcccgactccggggcagcccctgccgccccagccgatcccgactccggggcggcccctgacgccccagccgatcccgactccggggcggcccctgacgccccagccgatccagatgccggggcggcccctgaggctcccgccgcccctgcggctgctgagacccgggcagcccatgtcgccccagctgcgccagacgcaggggctcccactgccccagccgcttctgccacccgggcagcccaagtccgccgggcggcctctgcagcccctgcctccggggccagacgcaagatccatctcagaccccccagccccgagatccaggctgccgatccgcctactccgcggcctactcgcgcgtctgcctggcggggcaagtccgagagcagccgcggccgccgcgtgtactacgatgaaggggtggccagcagcgacgatgactccagcggagacgagtccgacgatgggacctccggatgcctccgctggtttcagcatcggcgaaatcgccgccgccgaaagccccagcgcaacttactccgcaactttctcgtgcaagccttcgggggctgcttcggtcgatctgagagtccccagcccaaagcctcgcgctctctcaaggtcaagaaggtacccctggcggagaagcgcagacagatgcgcaaagaagccctggagaagcgggcccagaagcgcgcagagaagaaacgcagtaagctcatcgacaaacaactccaggacgaaaagatgggctacatgtgtacgcaccgcctgctgcttctaggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaa

SEQ ID NO: 12652 - DNA, 729 bp, Homo sapiens
ccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagatgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagta

SEQ ID NO: 12653 - DNA, 632 bp, Homo sapiens
cccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagacagtgagaaggcaacc

SEQ ID NO: 12654 - DNA, 6403 bp, Homo sapiens
agttaccacgtcagtgagctgacagggaaggtacccggctctactgcccgtcccggacgactcatcctggcggactgtgcagtcccaccctgacttcggcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtttgccaagatggtggataagaatatttacatcattcaaggggagattaacattgtggttggggccatcaaacgaaatgcccgatggagcacccatacaccactggatgaagaacgggatcctctgctgcatagtttcggtcatctaaaggaggttttaaacagtataacagaactctcagaaattgagcccaatgtattccttcgaccttttctggaagtgattcgctctgaagataccactggccctatcactggactggcactcacctctgtcaacaagttcctgtcctatgcactcatagatcccacccatgagggcacagcagagggcatggagaacatggcagatgctgtcacccatgctcgttttgtgggcacggatcctgccagtgatgaagttgtcctgatgaaaatccttcaggttctacggactctgctgctaaccccagtgggtgcccacctaaccaatgaatctgtgtgtgagattatgcagtcttgcttccggatctgctttgaaatgaggctcagtgagttattgagaaaatccgcagagcacactctcgtagacatggtgcagctgctcttcacaaggttacctcagtttaaagaagaacccaagaactatgtggggaccaacatgaagaagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccagctactcagcatagagcgactaaacctttatgctgcttccctgcgagtatgcttcctactgtttgagagcatgcgagagcacctcaagttccaaatggagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatactgagagaactgccagcgatgggaaagctgtaggcatggcctcagacatcccaggcctgcatctgccaggtggagggcggctgccaccagaacatgggaaatcaggatgcagtgatctggaggaagctgttgactctggggctgacaaaaagtttgcccggaagccaccccgattttcctgtctcctgccagatccacgggaactaattgaaattaaaaacaaaaagaagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgagcaccttcagttttcagggtctgcgactggacgaagccctccgcctctacctggaagccttccgtttgcctggggaagcaccagtcatccagaggttgctggaggcattcacagagcgttggatgaattgtaatggctccccatttgccaatagcgatgcctgcttttccctggcctatgctgtcatcatgcttaatactgaccagcacaaccacaatgttcgtaaacagaatgcacccatgaccctggaggagtttcgcaaaaatctgaaaggtgtgaatggaggcaaggactttgagcaagacatcctggaggacatgtaccatgccatcaagaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggaagtgcgccatgatctccgcccactatggcctcagcgatgtgtttgacaatctcatcatctctctatgcaaattcacagctctcagcagtgagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtagaagatttcgtggatcccaatggcaagatctctctacagcgggaagagacaccatcaaaccgaggagagtcaacagtgctgagctttgtgagctggctaacactgagtggtcctgagcagtctagtgttcggggcccatccactgaaaaccaagaggccaagagagtggccttagagtgtataaagcaatgtgacccagaaaaaatgatcacagaaagcaagttcctccagctggagtcactacaggagctcatgaaggctctggtctcagtgacaccagatgaagagacatatgatgaggaagatgctgctttctgcctagagatgctgctaaggattgtgttggagaacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcattgtgcgtgatgctgcccacatcacacctgacaactttgagctctgcgtcaagactctccggatctttgtggaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtattgcctgcctgtgctgcgatgcccggcgccaggtacggatgcaggcactgacctatctgcagcgagcactacttgtacatgatctgcaaaagctagatgccctggaatgggagtcctgttttaacaaggtgctgtttcctctacttaccaagctcttggagaacatcagccctgcagatgtgggtgggatggaggagacccggatgagggcttccacattgctctctaaggtcttcctgcagcacctgtctccactgctgtcactctctacctttgcggccctctggctcaccatcttggacttcatggacaagtacatgcacgcaggctccagcgacttactgtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgcccccagagattccatctgagctgggggcctgtgactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagcatca

SEQ ID NO: 12655 - DNA, 8288 bp, Homo sapiens
atttaaatacgcggcgccggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcacagtccacgtgcactgcaggaccggagcgacacatgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgcctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggctgcagtgcagtggcgcgatctcagctccctgcaacctccacctcctgggttcaagcaattctctgcctcagcctcctgagtagctgggattccaggcacccgccaccacgcctggcttatttttgtatttttagtagagatggggtttcaccatcttggccaggctggtcttgaactcctgatctcatgatccacccgcctcagcttcccaaagtgctgggattacaggtgtgagccaccctgcctggccaaaacatttgtcatctttataaatggtcagaatagaaaagttagctctgccagtatcttcaattacttattacaagaatgtctttcatcatcttacttggagcattttccaatgactggctcttgagagccccaggcagggccccgagcaagtttttctaagtgccaaggccagcaaagtctgaactggccgcactcattaagtccctcatttggcaaaacaaaacagggcctggggcacccctggttcctggccttataggtcagtcaactggctgagaaatggtcaagaaaagaaacaatgacccttctgtggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgtt

SEQ ID NO: 12656 - DNA, 9327 bp, Homo sapiens
atttaaatacgcggcgccggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcacagtccacgtgcactgcaggaccggagcgacacatgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgcctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggctgcagtgcagtggcgcgatctcagctccctgcaacctccacctcctgggttcaagcaattctctgcctcagcctcctgagtagctgggattccaggcacccgccaccacgcctggcttatttttgtatttttagtagagatggggtttcaccatcttggccaggctggtcttgaactcctgatctcatgatccacccgcctcagcttcccaaagtgctgggattacaggtgtgagccaccctgcctggccaaaacatttgtcatctttataaatggtcagaatagaaaagttagctctgccagtatcttcaattacttattacaagaatgtctttcatcatcttacttggagcattttccaatgactggctcttgagagccccaggcagggccccgagcaagtttttctaagtgccaaggccagcaaagtctgaactggccgcactcattaagtccctcatttggcaaaacaaaacagggcctggggcacccctggttcctggccttataggtcagtcaactggctgagaaatggtcaagaaaagaaacaatgacccttctgtggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgtt

SEQ ID NO: 12657 - DNA, 8255 bp, Homo sapiens
atttaaatacgcggcgccggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcacagtccacgtgcactgcaggaccggagcgacacatgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgcctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggctgcagtgcagtggcgcgatctcagctccctgcaacctccacctcctgggttcaagcaattctctgcctcagcctcctgagtagctgggattccaggcacccgccaccacgcctggcttatttttgtatttttagtagagatggggtttcaccatcttggccaggctggtcttgaactcctgatctcatgatccacccgcctcagcttcccaaagtgctgggattacaggtgtgagccaccctgcctggccaaaacatttgtcatctttataaatggtcagaatagaaaagttagctctgccagtatcttcaattacttattacaagaatgtctttcatcatcttacttggagcattttccaatgactggctcttgagagccccaggcagggccccgagcaagtttttctaagtgccaaggccagcaaagtctgaactggccgcactcattaagtccctcatttggcaaaacaaaacagggcctggggcacccctggttcctggccttataggtcagtcaactggctgagaaatggtcaagaaaagaaacaatgacccttctgtggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgtt

SEQ ID NO: 12658 - DNA, 4373 bp, Homo sapiens
aatgagcaaggaggccgagtgggacttcctcccggaatcccgttggccagaatagccgggccgtgggtgacacgtaagttgggcaggaggtggcggggcggcagaggcaccagccgacccgtcagtgacaccgctgtgccgtccccaaaaccagccgagacagctggcccccacccttccacccattgggcaggccgcacgggggcgcggcccggagtcctggtccctttgttgggcgcgcaccccctcccttaggtggcaacaaagtcgtgcagtgggagccgccgcgatagggcggggagtggccagggcgggactccaagaactgcccgggggcagcggggccaaaaagtgggaagaaggaaaaaaggcaggaggcatctggggacaggcgcgagggcagccggctctgaagtatgcggagggcctcctcccggccccgggcattcgcggagaacgagcctcgcagaagtttggctgcagctgcccgggcggcgtcgatggctgcgcgccccgcgccgcgcgggggctgagcgggcgccacttcccctccgggccggcttttgtgtctggcatctcctcctcatgctgcgtctggccacctactgcggcggccgctgctgagacgctcgctcggaccaaggggaggagacggcgggggcggccgcggctttgggtccaggcgggactatgggaaacgggatgtgctcccgaaagcagaagcggattttccagacgctgctgctgctgaccgtcgtgttcggctttctctacggcgcgatgctctactacgagctgcagacgcagctgcggaaagccgaggcggtggcgctcaagtaccagcagcaccaggagtccctctccgcccagttacaagttgtatatgaacacagatcaagattagagaaatccttgcaaaaagaaagacttgaacataaaaaagcaaaggaagattttcttgtttataagttagaagcacaagaaacattaaataaaggaaggcaagattccaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacaccaagacatacatacacagcttcaagatgtcaagcaacagcataagaatttactctccgagcatgaacaacttgtagtgactttggaagaccacaagagtgcactagctgctgcacagactcaagttgcagaatataaacaactgaaagatactctgaataggattccaagccttcgaaaacctgatccagcagaacagcaaaatgtgacccaggtggcacattctccacaaggttacaacacagcaagggagaagccaacccgagaggtgcaggaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtgtacccttcagccaagccaatgatcaaattccaatcaccctatgaggaacagttggaacagcagagactggcagtgcagcaggtggaggaggcccagcagctgcgggaacaccaggaagctttgcaccagcagaggctgcaggggcacttactacggcagcaggaacagcagcagcagcaggtggcaagagagatggccctgcagaggcaggctgagcttgaggagggccggccgcagcaccaggagcagctccggcagcaagctcattatgatgctatggataatgatatcgttcagggagcagaggaccagggaatccaaggagaggaaggagcctatgaaagagacaaccagcaccaagatgaagcagaaggagatccaggtaatagacatgagcctcgtgaacaaggaccccgagaagccgacccagaatctgaggcagatagggcagctgtagaagatataaacccagcagatgaccctaataatcaaggtgaggatgaatttgaagaagccgagcaagtgagagaagaaaatttgccagatgaaaatgaagagcaaaaacaaagtaatcaaaagcaagagaatacagaagtggaggaacatttggtgatggcaggaaatccagaccagcaggaggacaatgttgatgaacagtaccaggaagaggcagaagaggaggttcaggaagatttgactgaagagaaaaaaagggaactggagcataatgctgaagagacctatggtgaaaatgatgaaaatactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcggcacccaatttctagacaacgctcagccaacggattcttttcaagctgctcaaacataaatctgcctactgaactctaggatatttaattacaaaaattaagaacttagacttttttaaaacttttgtattagaaatgcgcatacatttatatgaatatattttgataacgtaggtctagagcttcttttatattcaagctaaacatgaaaaagaagaaaaacaataaagtaaacctgagcccccacgtcccaatttttttaatagattatgtgatgttggaaagctcattgattttgtatatgtttcagcgtgttacctttctggcttccagttcccaggtgttctttgtttgcctttgataaaatacaggatttaagaacagagagtactgcaaaatgccatgcagactttaaagagaatggcctgtttactaattgctgcccttctgatgtctttatgtatagctctgatagaattttcaccagtctatgtatctctggagtgagatctatgtacaaagtgacatacaattggaaatccatttttgttgtaaagacattgtttttcagacttttcagatcaattagaaaaatgtcattgctttaaaatcatagctgttctgtttaagaggaattgaatttaaaaatgagagagtattaaaactcatgtggcagtatcctggtcttaatcaggtattgcagtgttcaaacaaggtatggacacatcaacatattcaccttttggaaggactagtgacttggttaaaaactaatgagtgtttgcgtgtggtgtttctatgcgagcacccattctcaattttttttttttttttttgtttgaagccattgattgatattcttgtttcagtgtctggttccctataagtaatatatatttcctctttaagctctgtgcctcaatatgcaatcactttgataataagtataaatatgaagacataccaaactgcaaataggattatttttcaaaactatatggtgaaacatatggtgatatgatagacttatggtttttctgtttgctgggattgggtctgctttttgcctatgtgtaaggcattttaatcattgtgaatataatagattccttaaaataagaaaattaaaaatcagaaacttcccttggagtagagacatttcagttgcaagcataaagatttttaaatatataacactaggttatataattcatatatgtgtggttttgtattaataatcaaattaataaaaacatttcattttctaccattgtatgaacgtaattttattttttaataaccacactcatagatggttttgattgttccagttgagtgattgtgtatgtacgcataggaatgttttgttcagttgtactttgtatttccaataatcagaaatcttacctttatgtataaaaacccattatgtaatgtaaaatgtataatattgtacataatattcagaatacaattattttggtaaattagcttgtatttttaatgtcccagttgcagtatttaattatttgaaccatactgaaagttggtaatagtcaataaagctaaaaaaaaaaagtggcaaatctt

SEQ ID NO: 12659 - DNA, 2721 bp, Homo sapiens
acatcctccggtgacgtcagccggggccgccatattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagca

SEQ ID NO: 12660 - DNA, 2631 bp, Homo sapiens
atattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcag

SEQ ID NO: 12661 - DNA, 2999 bp, Homo sapiens
ctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttcttttgagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccagatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctctctgg

SEQ ID NO: 12662 - DNA, 3237 bp, Homo sapiens
aaacaccaaggtaggttgcctagtgatcctgaggaagctgatgtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggcaaatatcaacagttggattacgcggtggctcacgcctgtaatcccagcactttggggagccgaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttcttttgagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaattcttccacctcagcctcccaaagtgctgagattactggcttgagccactgcacccacccctccagactactttaaatgtctctgctctgactgaattgaaggaattgtaagtttcagttgctgaatatatcagtatatctgaactccagatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctaactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctctctgg

SEQ ID NO: 12663 - DNA, 973 bp, Homo sapiens
ttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggcaaatatcaacagttggattacgcggtggctcacgcctgtaatcccagcactttggggagccgaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatg

SEQ ID NO: 12664 - DNA, 1011 bp, Homo sapiens
gtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttg

SEQ ID NO: 12665 - DNA, 3722 bp, Homo sapiens
agatgggagggaggctgttgcaggctctcaggggggagagatggtgctggttctgggctagaagataaaaagataaaaagaaaacccaggagacatcaaggagctggcatttcttgtagacaggattagaagatgagtatagggaagaggtatgagttaaggctaggagattaaatggtgaagccatcaactggggtgggaggcgcaggcgagagtgagctgggtggaagaagggatgatgacaagaagggataatgatagtgattggatgagctggtttggggtagctcaagaaacggggatgctaatttggggctcagggtgcgcagaagccaccggagaagacgcccttgccagggggagtggggcaagaaaaggcaggaccgcctgatataactgaggacagcgaagggtggcaggagagtagcagggcagacggtctctgggtcaggggcggggagtcacgagggagccctcggacagcgcccgggccacgcaccataagggaggagtcattgctgctcatctcgggccgctcgcggctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgcaggaatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatatttt

SEQ ID NO: 12666 - DNA, 5220 bp, Homo sapiens
atcccggctgacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatgattgca

SEQ ID NO: 12667 - DNA, 5230 bp, Homo sapiens
atcccggctgacgttggacgacaaagatggcggcagggaccagcagttactgggaaggtgagggcgagaaggcctccggatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatg

SEQ ID NO: 12668 - DNA, 1204 bp, Homo sapiens
gttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaaaggttttcagtggtgaagataaacttgaataaggagataacttacacaagcagaaaaagcctcatctcttctggattcctttaatgccagtggtcatcaccaggtgtagatcagtcaccttttacccaggctgggaccaccaccttctcatctacagctcagatcgtctgatagaagagacaataagcattgctatggcaacaaaagaaaatatgacttcacagagaggaatgttgaagtcaattcacagcaaaatgaacactttggccagtatcctttttgaatgttcgcagtctgtgttttgagggtagaggggagaagtgtctgtgtgtgcttttatagggggcaggttgccatcatcagtagcagtagagcccatcagtaattgcataatatgaatatactgtgcattcctactttgtgaaagtttatgctctttagtaccattcctaaaagactgcacctcagaagtttcttactactagatgtagaagaaaaaaattataaatgtgaatttaaaaattatccaccaatttcttctacattttagaaagcttttaaattcatgttagaactccacactatacattattcttacctaaacatgataaattatatgcctttgttgtttttcccatttagagataagtcagtggcagatgcttggaagggggaaggaag

SEQ ID NO: 12669 - DNA, 5208 bp, Homo sapiens
atcccggctgacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatg

SEQ ID NO: 12670 - DNA, 1026 bp, Homo sapiens
ggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggtaatatattgggctcgagatgttttcattatcacaggagtttgggtttttttttttaatccctgcattggatatgtgcacatatatttaaaaggacaaagagaaaaatctgagaaaataaatgccatgctaaagggacttgttttacttttttttggggtcaccattataaaattctgaaaatatctaatagctcttgctatttcttggcgaagttgagtaatattcatcactgggtacatatacttccactatgggagacctagctagctagctgtaacagtgaaatagccaatggtcatgtatagacaataacgtggtgggtaagcgtgtactttcagctagctttgaagataatatggagggggaattatttactatacttagtatattgtttaagaaaacagtaaatgtgtatgcaccaataaaactaaataaacttttaaagatttaaatggaggatatgttaaaaatatggtagtacaaatagaaaggactttctaaataagacttgatactggaaaccataacgaatggctaatttgcttactacacagagatataatagaaataagaaaaagacagtaggaaaatggacaaaggatataaaattgcttacaaaaaaatgaatggccaaaactataaaaacattttcagcagtatttcc

SEQ ID NO: 12671 - DNA, 1011 bp, Homo sapiens
ggacgacaaagatggcggcagggaccagcagttactgggaaggtgagggcgagaaggcctccggatctcaggaaacaggctcgacagctggaaaatgaacttgacctgaaactagtttccttcagcaaactatgtacaagttacagtcatagcagtacccgagatggaagacgcgacagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaa

SEQ ID NO: 12672 - DNA, 1469 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatca

SEQ ID NO: 12673 - DNA, 3319 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatca

SEQ ID NO: 12674 - DNA, 2220 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctaacttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaa

SEQ ID NO: 12675 - DNA, 889 bp, Homo sapiens
gctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgatagagacaaggtctcaccatgttgcccagaatggacccgaactcctgagctcaagagatcctcctgcatcagcctcccgaagtgctgggattatagaattctcagagaaaataacttgactgaattacacaaggattcatttgaaggcctgctatccctccagtatttagatttatcctgcaataaaatacagtctattgaaagacatacatttgaaccactaccatttttgaagtttatgtaagttac

SEQ ID NO: 12676 - DNA, 2090 bp, Homo sapiens
gtagaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccgg

SEQ ID NO: 12677 - DNA, 2251 bp, Homo sapiens
aacaattcaggcccttgtcccaagtaggaggacattccccaagcaggcgggtaaagtctcctcctggtcaagtgctaacgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgccc

SEQ ID NO: 12678 - DNA, 2255 bp, Homo sapiens
acaacaattcaggcccttgtcccaagtaggaggacattccccaagcaggcgggtaaagtctcctcctggtcaagtgctaacgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcagg

SEQ ID NO: 12679 - DNA, 4590 bp, Homo sapiens
ggggcaggctgggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 12680 - DNA, 4450 bp, Homo sapiens
tcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 12681 - DNA, 4604 bp, Homo sapiens
gggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggtaagtagaagtagttccaagatggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 12682 - DNA, 2528 bp, Homo sapiens
tgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttaggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 12683 - DNA, 946 bp, Homo sapiens
ccaaggtgggcggatcacaaggtcaggagattgagaccatcctggctaacatggtgaaaccctgtctctactaaaaatacaaaaaaaaattagccgggcgtggtggcgggtgcctgtagtcccagctactcgggaggctgaggaaggagaatggcatgaacctgggaggcggagcttgcagtgagccgagatcgtgccactgcactccagcctgggcaacagcgtgagactcgtctcaaaaaaaaaaaaaaatccatatttcattccagctttacaagatggggaaatggaggttcagggaagcatgtaagctagattgttgtttaaccagtattgggggttaaaggggtagctgtctggtcgtgtttacaccacttcatgtagacctgttggccctctttccttgccactatccatttctggattcagtcttccccagaacctcaccctttgcctgccctcagctgactgctcattcatttgccaaggggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtg

SEQ ID NO: 12684 - DNA, 2688 bp, Homo sapiens
gggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacgtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgg

SEQ ID NO: 12685 - DNA, 3159 bp, Homo sapiens
gaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgga

SEQ ID NO: 12686 - DNA, 2107 bp, Homo sapiens
ctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaaggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctag

SEQ ID NO: 12687 - DNA, 3205 bp, Homo sapiens
agtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccgtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagcgctgtgagcggatgcggcccacgctcttccgactggcgagtgacacagaggacaatgatgaggccttagcggagatcctgcaggccaatgacaacctcacccaggtgatcaacctgtataagcagctggtgcggggtgaggaggtcaacggtgatgccacagccggctccatccctgggagcacctcggccctgctggatctctcaggcctggatctcccgcctgcgggcaccacctacccagctatgcccacccgccctggcgagcaggccagccctgagcagcccagtgcctcagtttccctgcttgacgacgagctcatgtctctgggcctcagtgaccccacacccccttcaggcccaagcctggatggtaccggatggaacagcttccagtcgtcggatgccactgagcccccagcccctgctctggcccaggcccccagtatggaaagccgacccccagcgcagacatccctgccagcaagcagcggtctggacgacctagacctcctggggaagaccctcctgcagcagtcgctgcccccggaatcccagcaagtgcggtgggagaagcagcagccaaccccccggctcacactccgggacctgcagaataagagcagcagctgcagctcccccagctccagcgccaccagccttctccacaccgtgtccccagagccccccaggcctccgcagcagcccgtaccaaccgagctctcactggccagcatcactgtgcccctggagtccatcaaacccagcaacatcctgcccgtgactgtgtatgaccagcacggcttccgcatcctcttccattttgcccgggacccactgccagggcgctccgacgtgctggtggtggtggtttccatgctgagcaccgccccccagcccatccgcaacatcgtgttccagtcagctgtccccaaggttatgaaggtgaagctgcagccaccctcgggcacggagctgccagcttttaaccccatcgtccacccctcagcaatcacccaggtcctgctgcttgccaacccccagaaggagaaggttcgcctccgctacaagctcaccttcaccatgggtgaccagacctacaacgagatgggggatgtggaccagttccccccacctgaaacctggggtagcctctagaacagaggggctggggagaggaaggggcagagggaccggtcactgtccagcctggagggaggcattggtggccaaggacaccctttgttgcccatggccattcacccccaggcctggtgcttctccccacacccctgtaggcctcaagtgactcttccccctcctgctccggccccgcccctgctgagccaaacccagtaggaggctgggcctgggtttgtgccgctggggtctccatcaccgggacctggagagggaggggctgtgtagccttggaagaacttgggtcatggggaggaagcacagctgttggggaagggccaggacctcaggcccagccccaaccccagctggggtggggtcttccccacctgtctcttatgccttatgggaaggcccagccataactcgggggccatgctggagctggggaccagcttaggcctcctccataggaacccagtgactggggggtgacgcctacacccccagctatttgcactctggtgtgtggtttgactctgcttttcttccggattggccctgtggtcacagcctcagggggccaggctgggggaacctcacctggcccgtactcctgggggtttccctttgccattgggccccctgagggactgtgggggctcaagggtaatgccagaggcccatggccccagcgaggggctgtggggcacctagagttctcggtgtgtctccttcattcattggcctctgctggggcctcctatgggtgtcttacgtctgtccatccatctgtccgtggtcagaagtggggtcagtgtgtgagtgagagcaggagtatttatgaaaataaaacgtcgtttttcctgg

SEQ ID NO: 12688 - DNA, 661 bp, Homo sapiens
gggccccttcccggcgggggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaa

SEQ ID NO: 12689 - DNA, 565 bp, Homo sapiens
ctctaaaagtggggccctttggagggcagctgtgctcatctgtctgtctacacccacaatcagatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgct

SEQ ID NO: 12690 - DNA, 1714 bp, Homo sapiens
ggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgagaaggggagaggccaccatccgtcccccgccatgtgacgacaccaagggaggccaagactgaggttcttggggtccataaggctcttcagagcccaagagagttgtgctaagatggcccaggatggaggtccgggcctgccccaagggtcccaccacagccagcgggctggcctcccaccccagcatccatacacgtaggcctgttgctgagggaaggccctctagggtcatctggtccaggggttctttgcttcagctgcacatcggctgcctctccaggaagcgtgttcaacacatggaatcagggctccacccagacctgccgaggccacactcctggagtatctgcatccagagatctgcacgtttgtaaagctaaggggtggtgcttgggctcaggcctgaggttttgcatctgttcaatagcagaggagagaggggtgtactgtctgtggcccccagcatgggccacataccaacccaccatggagcaaagctgattttaagtggtggtagagatacagtttctcttttaatacttacgtgtttagttgggtgcagtggcttatacctgtaatttcagcacttggggaggccaaggcaggaggcttgcttgaggcaaggagttcaaggctacagtgagctatgattgtgccactgtactccagactggacaacagagtgagaccccatctctaaataataatcattattgttacatatttgttttaacatttttttctcaagtataactagtcctatgatttcatagatgtagcttaggataaggccaaggtaggtgttgcctatataaggtttttttaaaaaaggaaaaataggccgggctggtggctcacgcctgtaatcccagcactttggcaggctgaggcgggcagatcacctgagatcaggagttcaagatcagcctgaccaacatggagaagccccatgtctactaaaaataaaaaattagcgaggcgtggtgggcgggcgcctgtaatcccagctacttgggaggctgaggcagaagaatcatttgaacccaggaggcagaggttacagtgagccgagatcgtgctactgcattccaacctgggcaacaagagtgaaactctgtc

SEQ ID NO: 12691 - DNA, 559 bp, Homo sapiens
gtggaagagcaggaatcccactgccgggccacaatgaccccagctctcctcttccagatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgct

SEQ ID NO: 12692 - DNA, 566 bp, Homo sapiens
gtgccgaggctgggggccggtggcggatggagcccgcgatggagccggagactctggaggcgcgaatcaagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgc

SEQ ID NO: 12693 - DNA, 483 bp, Homo sapiens
gagcgatggaggaccccggccccggcgcggtccagcggtgggagcgggcgccgcccacctgtcggatccctgggccatgacccctgggacggcgagtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttct

SEQ ID NO: 12694 - DNA, 568 bp, Homo sapiens
ggaaccggaaccgggggcacgaggcgggccccttcccggcgggggcggggggagacaggtgtggacatgagtggctgggatgcagtgccgtagcaggctgggggacacaaaagagaactgacccagcactgctaccctgggcaggagtagaggattagagaaggggacaccggagccactcccaagggaatgaaggctttctgaacctggtgtgatgagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgc

SEQ ID NO: 12695 - DNA, 577 bp, Homo sapiens
agtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaag

SEQ ID NO: 12696 - DNA, 927 bp, Homo sapiens
ggggcacgaggcgggccccttcccggcgggggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgaatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggattgtaaagtccgaccccaagcttccagatgacactacctttccccttcctcctccacggccgaagaatgtgatctttgaagatgaggagaaatccaagatgctggcccgcctgctgaagagctcccatcccgaagacctccgcgcagccaataagctcatcaaagagatggtgcaggaggaccagaagcggatggagaagatctcgaagagggtgaatgccatcgaggaggtgaacaacaatgtgaaactgctcacggagatggtgatgagccacagccagggcggcgcagcagctggcagcagcgaggacctcatgaaggaactgtaccagc

SEQ ID NO: 12697 - DNA, 639 bp, Homo sapiens
gggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagagtagaggattagagaaggggacaccggagccactcccaagggaatgaaggctttctgaacctggtgtgatgatagagccacgaaccccctgaacaaggagctcgactgggccagcatcaacggcttctgcgagcagctcaacgaggactttgaggggcctccactcgccacccggctgctggcccacaagatccagtccccacaggagtgggaggcgatccaggccttgacggtgctggaaacatgcatgaagagctgcggcaagcggttccacgacgaagtgggcaagttccgctttctcaacgagctcatcaaggtcgtgtctcccaagtatctgggctctcggacatcggagaaggtgaagaacaagatcttggagctcctctacagctggacagtgggcctgcccgaggaggtgaaaatcgcagaggcctaccagatgctaaagaagcaggggat

SEQ ID NO: 12698 - DNA, 3876 bp, Homo sapiens
ctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtgggggtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 12699 - DNA, 3777 bp, Homo sapiens
ctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtgggggtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 12700 - DNA, 3879 bp, Homo sapiens
acaacaattcaggcccttgtcccaagtaggaggacattccccaagcaggcgggtaaagtctcctcctggtcaagtgctaacgataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtgggggtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 12701 - DNA, 976 bp, Homo sapiens
gaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacaggcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctca

SEQ ID NO: 12702 - DNA, 1967 bp, Homo sapiens
tgcaatatggcggaggcggaaggggaaagcctggagtcctggctcatacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctg

SEQ ID NO: 12703 - DNA, 9252 bp, Homo sapiens
ggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatactgaatatcataatccaatctttgttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgatgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaagattttc

SEQ ID NO: 12704 - DNA, 8871 bp, Homo sapiens
ggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacgagaaaggagccgaaaggcgaggccagctcttccaaccctgccacgcccatcaagatcccggactgcccagttcccgcctcgctgctggaggagctgctgagaccaccgcccgccgtgagcaaggagcccctcaagaacctgaacagctgcctccagcagctcaagcaggagatggacagcctgcagcgccagatggaggagcacgccctgacggtgcacgagtctctgtcctcgtggacgccgctggagccagccactgccagccctgtgcccccggggggtcacgccggcccacgcggcgacccacagagacacagtcagagcagggcttccaaagaagggccgggagagtgactgctgtggactcgcctccgtgcgccgctgccccagaaggctcttatcaatgttatttatttgattgtgtggtcgatgtttttctaagacatgaaatttaagttttgttttgcctttaacaagaagtaaaatatatagcagaatgagagccaaggactagaaaaacattcgaagatcacaattagcttttcacatggaatgaccaactcttaaaagcctgataggctctcggcgaggagctttgaacgtgtctgaagggttacttgtaggtcgtggcttctgagcggccaccgatgctgctctctgcgggtgacagggagaggctgcgtaactgggagcagctgtgtgacagggtctgcggcaccgcgcctggccaggccggctgcagtttctcacttccctgttccattcagtaagagctttacttttccgcagaaatgaaattttatctgtacctttggctttttacttgtttttttggatagccatcccaccataggatgtgtacatagatactgaatatcataatccaatctttgttttttttttttttttttttttgagacagagtctcgctttgttgcccaggctggagtgcagtggcacactctccgctcactgcaagctccgcctcccaggttcatgcgattctcctgcctcagcctctcgagtagctgggattacaggcgtgcgccactatgccaggctaatgtttgtatttttagtagcaatggggtttcaccatgttggccaggatggtctcgatctcctgacctcaagtgatctgcccatctcagcctcccaaagtgctgggattacaggcgtgagcccctgcgcccggcctgtcacccagtctttaagaagcatatgctcatgttattgaagaagaacctacttattattgattgccttttgaaaatttgttgggaataatttacctgcaggatttagggatagtcagaaaattctaagaaatataattattttatttaccttctaaagccaaatattcttacacagaaaggtcctctgttgttctggttttactttgttgctgaggatctttccttcctgctggtctcttcctctcaggccactggccctgtgtgattccaccgtggctggccactgggaaggggcagcttggacccttggtcaggcctgacggccatcaggaggcacaaggacactgaggccccatatctgatctgacctttgggggggcacagggagaggccggtggaggaggaggaggagagcagaccaggggctccctgcagcgactcccgcggtttcccctggagtcagccaggtgtaggtcgcaggcggtaacaaacctcacactcctgttccccaagtgaaaatctttaccattgtctgtgggagcgcctgtactcgtgtgtaggagcacctgtacttctgcagtcatcgagaagtcctggatcttttgtggttacaccagcatcatgtggcaagcagaggcgacttccggaagagacaggcaggcaccgtgaggaaggtggctgtgctctcccaggtgtctcagagacagatgccttatttaaaatcagcacgacatgtgtgagatcttctgtttcctaccccaaatcctgaaaccctgcagacactggctgactgggagaggtggggtctgtaagttgtcccctagtttgctaagaaaatctaaaataatatttattatatgagttaggagagagagaatgggtccgcgtggcctcctctgcagatgtactggtctgaaatgaggttctgagtcactggccaggccagatgtgctcatgtcggtgtctggtgtctgttttgtggagaaaacagtatggtgtgttttaagctatttgtgttctgttgtaatatacttttagaaggttaattggtaaggttaaggtagcattaaccacaaagatgtttggtatttaaaaaatattctctagcaaatattggaatttccaaaatatatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcctcacggaaaaggcagtgaagttgggagtactgcttacaaaacagggtcaccagtgcattatgtggcgtgttcatccccacgccgtgtgtcacgggctagggcggcgtgttcatccccacaccgtgtgtcacaacaggctagggcacttcacgatgtcactacttgtttttctgatgttccaaaaacaacgtaacttggttttcatgtgtttttccgtggtatatgtgagattgatgctacgggtcttacggactcacacccgttcccactctctgcaatatggatcaggcagtgtttctgataggatgtgaaatggactctcctcgggtgggtccagcaggggccctgcccaccagaacacagtccgtgctgtgctgcgctaaggagctggccctcaactctccttggtgcagggttcccacaaccgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaaatttcctcacaaaagagagtcctcaagttgtggctgttcttgggaaaggggtcaccgtgtctgacaaagtgtaactttaaaaagcacgttgattttttacaaatgtaagtgtgcttgggaattccttaaattttgtgcaataaactattttttggtaaag

SEQ ID NO: 12705 - DNA, 5496 bp, Homo sapiens
tccgccggagcatccgggccgggcggcctccggggctgccagagcagcagggtgaggggctcggaggccgcggcgcctcggggctcgggctcccgctcccgctcccgctcccgcagtgcatgggcgggggaggctcgaggggcggcggcggggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgagcttcaagaatccagaggctttaggaagaagataaaacgccttgaggagtcaaacaagaagttggctcttgaattagagcacgagaaagggaagcttacgggcctcggtcagtccaacgcagctctgcgggaacacaacagcatcctagaaacagctttggccaagagggaggcagacctagtccagttgaaccttcaggtgcaggcagttttgcagcgcaaagaagaggaggatcgccagatgaagcatcttgtccaggccctgcaggcctcactagagaaggagaaggagaaggtgaacagcctcaaggagcaggtggctgctgccaaggtggaagccgggcataaccgccgccacttcaaggcggcctccttggagctgagtgaggtgaagaaggagctgcaggccaaggaacacctggtgcagaagctgcaggccgaggccgacgaccttcagattcgggaggggaaacattcccaggagatagcacagttccaagcagagctggccgaggcccgggcacagctccagctcctgcagaagcagctggacgagcagctcagcaaacagcccgtgggaaaccaagagatggaaaatctcaaatgggaggtggatcagaaagaaagagaaatccagtccttgaagcagcagctggacttgacggagcagcagggcaggaaggaactggaagggctacagcagctgctgcagaacgtcaagtctgagttggagatggcccaggaagacctgtccatgacccagaaggataaatttatgctccaggcaaaagtgtcggagctgaagaacaacatgaagaccctgctccagcagaaccagcagctcaagctggacctacgccgcggcgcggccaagacggtactcaggcccgcgtccctcccggggtagccgacgtgcgctgtagatgctctcggacaggaggctggcagacgtgttagtcattcagacataaacggatttgttgagcccacactgagcagctgctgtgtagtcagtggtaatggggtgacagatgaaatcatttcattctggtttcattcatccaacagtgttttcctcgttctgtgaattcaaataccactttgttgtaatgtgctttgtaaagcagatgagcggtggtctgtgactcggcagtccctgctgtgtgtgaagggctggggcccgggagctgtgcccaggcgcccggcggttttctgtgctcggtccacatccatgttttccaggaggcaggtgggagggcagcgctcggattgagaggccgtttagcgtcgtgtgcttatctgtggaaaaagtttgaagtcccagaaaagggagcctaagctggaaaacttacttaatttcttacggaaattccacatcaaggtcttgagtatctgatgggagaagcgtctgggagagctgtagtctgtggctcggccccgtcctgccgcagacccaggacttaggttgtctctgctttgctctggttttgtgccttaggaataaaggtgtttcctcagcc

SEQ ID NO: 12706 - DNA, 3784 bp, Homo sapiens
ccgggccgggcggcctccggggctgccagagcagcagggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcagctcagctggtgtcgtcctgaccatggacggcgcgtcggccgagcaagatggcctccaggaggacagatcccacagtggcccctcgtctctccccgaggccccactgaagcccccgggcccactggtgccacctgaccagcaggacaaagtccagtgtgccgaggtaaacagagcatccacggaaggggaaagcccggatggacctggccagggaggcctctgtcagaacgggccaacgccacccttcccagaccctccgtcgtctctcgatcccaccacaagcccagtgggccctgatgcctctccaggtgtggctggtttccatgacaacctaaggaagtctcagggaactagtgctgagggcagtgttagaaaagaagctttgcagtctctcagactcagtcttcctatgcaagaaacgcaactgtgctctacagattctcccctgcccctggagaaggaggagcaggtccgacttcaggctcggaagtggctggaagagcagctcaaacagtacagggtgaagcgccagcaggagaggtccagtcaacctgcaaccaaaacgagactttttagcacgcttgatcctgagctcatgttaaacccagaaaacttaccaagggccagtaccctggctatgacaaaagaatattccttcctgcgcaccagtgtccctcgggggcctaaggtgggcagcctggggcttccggcacatcctagggagaaaaaaacttccaaatcaagcaaaatccggtctctggccgattacagaactgaagattcaaatgcggggaattctgggggaaatgtcccggctcccgattctaccaagggttccctgaagcagaacagaagcagtgcggcgtccgttgtgtctgagatcagcctgtcccccgacactgacgaccgtctggagaacacctccctggctggagacagcgtgtctgaggtggatggaaatgacagcgacagctcatcgtacagcagcgcctccacccgagggacctatggcattctgtcgaagacagtgggcacgcaggacaccccctatatggtcaacggccaggagattcctgcggataccctgggccagttcccctccattaaggacgtcctccaggccgcagccgctgagcaccaagaccaggggcaggaggtcaacggggaggtgcggagtcggagagacagcatctgcagcagcgtgtccttggagagctctgcagcagaaacacaggaggagatgctgcaggtgctcaaagagaaaatgcgactcgaaggacagctggaagccttgtcactggaggcgagtcaggcacttaaagagaaggctgagctgcaggcccagctggccgccctcagcacgaagctgcaggcgcaggtggagtgcagccacagcagccagcagcggcaggattcgctgagctcggaggtggacaccctgaagcagtcgtgctgggacctggagcgagccatgactgacctgcagaacatgctggaggcaaaaaatgccagcctggcgtcgtccaacaacgacttgcaggtggccgaggagcagtaccagaggcttatggccaaggtagaggacatgcagaggagcatgctcagcaaggacaacacagtgcacgacctgcgacagcagatgacagccttgcagagccagcttcagcaggtgcagctggagcggacgacgctgaccagcaagctgaaggcgtcgcaggcggagatctcgtccctgcagagtgtccggcagtggtaccagcagcagctcgccctggcacaggaggcccgcgtcaggctgcagggtgagatggcccacatccaggttggacagatgacccaggcaggtctcctggagcacctgaaactcgagaatgtgtccctgtcccagcagctgacggaaactcagcacaggtccatgaaggagaaggggcgcatcgcggcacagctgcagggcattgaggctgacatgttggatcaggaagcagccttcatgcagattcaggaggcaaagacgatggtggaggaggaccttcagaggaggctggaagagtttgaaggtgagagggagcggctgcagaggatggcggactcggcggcatccctggagcagcagctggagcaggtgaagttgactttactccagcgagaccagcagcttgaggctttgcagcaggagcacctggacctgatgaaacagctcaccttgactcaggaggctctgcagagcagggagcagtccctcgatgccctgcagacacactacgatgagctgcaggccaggctgggggagctgcagggcgaggccgcctccagggaggacacgatctgcctcctgcagaacgagaagatcatcttggaggcggctttgcaggcggccaagagtggcaaggaggagcttgacagaggagcaagacgcttggaagaaggtaccgaggaaacgtcggaaactttagagaagttaagagaagaattagctatcaaatccggccaggtggaacacctgcagcaggagactgctgctctgaaaaagcaaatgcaaaaaataaaggaacagtttctccaacaaaaggtgatggtggaggcctaccggcgcgacgccacctccaaagaccagctcatcagtgagctgaaagccaccaggaagaggctggactcggagctgaaggagctgcggcaggagctgatgcaagtgcacggggagaagcggactgccgaggcggagctctcgcgcctgcacagagaggtggcccaggtccgtcagcacatggcggaccttgaagggcatctccagtcggcgcagaaggagcgagacgagatggaaacacacttgcagtcgttgcagttcgataaggagcagatggtcgcggtcacagaggccaatgaggcgctgaagaaacaaatcgaagagttgcagcaagaggcccggaaggccatcacggaacagaagcagaagatgaggcggctgggctcagacttgaccagcgcccagaaggagatgaagaccaaacataaggcctacgagaacgccgtgggcatcctcagccgccgcctgcaggaggccctcgcggccaaggaggctgcggacgcggagctgggccagctccgagcccagggtggcagcagtgacagcagcctggctctacatgaaaggatccaggccctggaggcggagctgcaggctgtcagtcatagcaagacgctgctggaaaaggaactgcaggaggtcatagcgctgaccagccaggagctggaggagtcccgggagaaggtgctggagctggaggacgaggtgaggcctggccatctgctgtggcggcagcgtggggcaggtcacgtgagccctggacatgccgccacgcgtgagacccgaagaacaaaacttcaccgtgtgcccagcgttgctacttttggtgttgccaccttctgaccgtcggcctctggctctgtggtggggcaggccctgattccagccctctggggaggatcactgtacagcctctttggtggaatggttacagaattcatagtggaacccttctcagttcaaatgctttggttgcaaataagaaacccaacttcgccagg

SEQ ID NO: 12707 - DNA, 7772 bp, Homo sapiens
atgtgcgggacccgacattgtgcttgtcccatccggtgctccgtagttagcctctgtgagctccacgtaggccgcgcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtttacttcacctcgcagtggtatcttctgagtaaaccatcagtctgtgcttagttaacatgtgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactatataaca

SEQ ID NO: 12708 - DNA, 7673 bp, Homo sapiens
gcaagcgcccttggcgcacagttcacctgctgccgttgtcgtcgccgccgcggctcccggggctggatggggggccgaggccagccagtggcacccggaagaaagagacgcggcggcggcgacgccgacaccctcaggacgagtgtccggacttgcccacagcctcaaggaggagacggcgaggcccggcccccgctgtccctggtgtaaagaagtcgccgtagccgtcgcggccgggactccccgggctctcgcccttcaggtttcgttgacactcaggaccgtacgtacgctgcgccatgttcaagaaactgaagcaaaagatcagcgaggagcagcagcagctccagcaggcgctggctcctgctcaggcgtcctccaattcttcaacaccaacaagaatgaggagcaggacatcttcatttacagagcaacttgatgaaggtacacccaatagagagaatgcatctactcatgcctcgaaatctcctgacagtgttaatggaagtgaaccaagcattcctcagtcaggtgacacacagtcttttgcacagaagctccagctccgggtgccctccgtggagtctttgtttcgaagtccgataaaggaatctctattccggtcttcttctaaagagtctttggtacgaacatcttccagagaatccctgaatcgacttgacctggacagttctactgccagttttgatccaccctctgatatggatagcgaggctgaagacttggtagggaattcagacagtctcaacaaagaacagttgattcagcggttgcgaagaatggaacgaagcttaagtagctacaggggaaaatattctgagcttgttacagcttatcagatgcttcagagagagaagaaaaagctacaaggtatattaagtcagagtcaggataaatcacttcggagaatagcagaattaagagaggagctccaaatggaccagcaggcaaagaaacatctgcaagaggagtttgatgcatctttagaggagaaagatcagtatatcagtgttctccaaactcaggtttctctactgaaacaacgattacgaaatggcccgatgaatgttgatgtactgaaaccacttcctcagctggaaccacaggctgaagtcttcactaaagaagagaatccagaaagtgatggagagccagtagtggaagatggaacttctgtaaaaacactggaaacactccagcaaagagtgaagcgtcaagagaacctacttaagcgttgtaaggaaacaattcagtcacataaggaacaatgtacactattaactagtgaaaaagaagctctgcaagaacaactggatgaaagacttcaagaactagaaaagataaaggaccttcatatggccgagaagactaaacttatcactcagttgcgtgatgcaaagaacttaattgaacagcttgaacaagataagggaatggtaatcgcagagacaaaacgtcagatgcatgaaaccctggaaatgaaagaagaagaaattgctcaactccgtagtcgcatcaaacagatgactacccagggagaggaattacgggaacagaaagaaaagtccgaaagagctgcttttgaggaacttgaaaaagctttgagtacagcccaaaaaacagaggaagcacggagaaaactgaaggcagaaatggatgaacaaataaaaactatcgaaaaaacaagtgaggaggaacgcatcagtcttcaacaggaattaagtcgggtgaaacaggaggttgttgatgtaatgaaaaaatcctcagaagaacaaattgctaagctacagaagcttcatgaaaaggagctggccagaaaagagcaggaactgaccaagaagcttcagacccgagaaagggaatttcaggaacaaatgaaagtagctcttgaaaagagtcaatcagaatatttgaagatcagccaagaaaaagaacagcaagaatctttggccctagaagagttagagttgcagaaaaaagcaatcctcacagaaagtgaaaataaacttcgggaccttcagcaagaagcagagacttacagaactagaattcttgaattggaaagttctttggaaaaaagcttacaagaaaacaaaaatcagtcaaaagatttggctgttcatctggaagctgaaaaaaataagcacaataaggagattacagtcatggttgaaaaacacaagacagaattggaaagccttaagcatcagcaggatgccctttggactgaaaaactccaagtcttaaagcaacaatatcagactgaaatggaaaaacttagggaaaagtgtgaacaagaaaaagaaacattgttgaaagacaaagagattatcttccaggcccacatagaagaaatgaatgaaaagactttagaaaagcttgatgtgaagcaaacagaactagaatcattatcttctgaactgtcagaagtattaaaagcccgtcacaaactagaagaggaactttctgttctgaaagatcaaacagataaaatgaagcaggaattagaggccaagatggatgaacagaaaaatcatcaccagcagcaagttgacagtatcattaaagaacacgaggtatctatccagaggactgagaaggcattaaaagatcaaattaatcaacttgagcttctcttgaaggaaagggacaagcatttgaaagagcatcaggctcatgtagaaaatttagaggcagatattaaaaggtctgaaggggaactccagcaggcatctgctaagctggacgtttttcagtcttaccagagtgccacacatgagcagacaaaagcatatgaggaacagttggcccaattgcagcagaagttgttggatttggaaacagaaagaattcttcttaccaaacaggttgctgaagttgaagcacaaaagaaagatgtttgtactgagttagatgctcacaaaatccaggtgcaggacttaatgcagcaacttgaaaaacaaaatagtgaaatggagcaaaaagtaaaatctttaacccaagtctatgagtccaaacttgaagatggtaacaaagaacaggaacagacaaagcaaatcttggtggaaaaggaaaatatgattttacaaatgagagaaggacagaagaaagaaattgagatactcacacagaaattgtcagccaaggaggacagtattcatattttgaatgaggaatatgaaaccaaatttaaaaaccaagaaaaaaagatggaaaaagttaagcagaaagcaaaggagatgcaagaaacgttaaagaaaaaattactggatcaggaagccaaacttaagaaagagcttgaaaatactgctctagagcttagtcagaaagaaaaacagtttaatgccaaaatgctggaaatggcacaggctaactcagctggaatcagtgatgcagtgtcaagactggaaacaaaccaaaaagaacaaatagaaagtcttactgaggttcatcgacgagaactcaatgatgtcatatcaatctgggaaaagaaacttaatcagcaagctgaagaacttcaggaaatacatgaaatccaattacaggaaaaagaacaagaggtagcagaactgaaacaaaagatcctcctatttgggtgtgaaaaagaagagatgaacaaggaaataacatggctgaaggaagaaggtgttaagcaggatacaacattaaatgaattacaggaacagttaaagcagaagtctgcccatgtgaattctcttgcacaagatgaaactaaactgaaagctcatcttgaaaagctagaggttgacttgaataagtctctgaaggaaaatacttttcttcaagagcagctagttgaactgaagatgctggcagaagaagataagcggaaggtttctgagttgactagcaagttgaaaaccacagatgaagaattccagagtttgaaatcttcacatgaaaaaagtaacaaaagcctagaggacaagagcttggaatttaaaaaactgtctgaggaactagcgattcagctagatatttgctgtaagaaaaccgaagccttattagaagctaaaacaaatgagctaatcaacattagtagtagtaaaactaatgccattctttctaggatttctcattgtcagcaccgtacaactaaagttaaggaggcactgttaattaaaacttgcacagtttctgaattagaagcacaacttagacagttgacagaggagcaaaatacactaaatatttcttttcaacaggctactcatcagttagaagaaaaagaaaatcaaattaagagcatgaaggctgatattgaaagtcttgtaacagaaaaagaagccttacagaaggaaggaggcaatcagcaacaggctgcttctgaaaaggagtcttgtataacacagttgaagaaagagttatctgaaaacatcaatgctgtcacattgatgaaagaagagcttaaagaaaaaaaagttgagattagcagtcttagtaaacaactaactgatttgaatgttcagcttcaaaatagcatcagcctatccgaaaaagaagcagccatttcatcactaagaaagcagtatgatgaagaaaaatgtgaattgctggatcaggtgcaagatttatcttttaaagttgacactctgagtaaagagaaaatttctgctcttgagcaggtagatgactggtccaataaattctcagaatggaagaagaaagcacagtcaagatttacacagcatcaaaacactgttaaagaattgcagatccagcttgagttaaaatcaaaggaagcttatgaaaaggatgagcagataaatttattgaaggaagagcttgatcagcaaaataaaagatttgattgtttaaagggtgaaatggaagacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaacaaaaaattgctgccattaagaagcagttgttatctcaaatggaagagaaagaagaacagtataaaaaaggtacagaaagccatttgagtgagctaaatacaaaattgcaggaaagagaaagggaagttcacatcttggaagaaaaacttaagtcagtggaaagttcacagtcagaaacattaattgtacccagatcagcaaaaaatgtggcagcatatactgaacaagaagaagcagattcccaaggctgtgtgcagaagacatatgaagaaaaaatcagtgttttacaaagaaacttaactgaaaaagaaaagctattgcagagggtagggcaggaaaaagaagagacagtttcttctcattttgaaatgcgatgccaataccaggagcgcttaataaagctagaacatgctgaggcaaagcaacatgaagatcaaagtatgataggtcatcttcaagaggagcttgaagaaaaaaacaagaaatattccttgatagtagcccagcatgtggaaaaagaaggaggtaaaaataacatacaggcaaagcaaaacttggaaaatgtgtttgacgacgtccagaaaaccctccaggagaaggaactaacctgtcagattttggagcaaaagataaaagagctggattcctgcttagtaagacagaaagaagtacatagagttgaaatggaagagttgacctcaaaatatgaaaaattacaggctttacaacagatggatggaagaaataaacccacagaacttttggaagaaaacactgaagaaaagtccaaatcacatttggtccaacccaaattgcttagtaacatggaagcccagcacaatgatctggagtttaaattagccggggcagaacgggagaaacagaaactgggcaaggagattgttagattgcagaaagaccttcgaatgttgagaaaggagcatcagcaagaattggaaatactaaagaaagaatatgatcaagaaagggaagagaaaatcaaacaggagcaggaagatcttgaactgaagcacaattccacattaaaacagctgatgagggagtttaatacacagctggcacaaaaggaacaagagctggaaatgaccataaaagaaactatcaataaggcccaggaggtggaggctgaacttttagaaagccatcaagaagagacaaatcagttacttaaaaaaattgctgagaaagatgatgatctaaaacgaacagccaaaagatatgaagaaatccttgatgctcgtgaagaagaaatgactgcaaaagtaagggacctgcagactcaacttgaggagctgcagaagaaataccagcaaaagctagagcaggaggagaaccctggcaatgataatacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatcttcatcttgaagaagagtgacattgggtgactgctgcttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcagtacctcattgtttacttagcttttgtacttatatttttcagaggaaaaaacactactgtaaattgtgaatagccaatacataactgtattgtatgcaaatctgtgattgttggcagtgtcatctctgagaaacagataaataaagtttatttactat

SEQ ID NO: 12709 - DNA, 2969 bp, Homo sapiens
agtcgcctgcaggtggctgttcgcgtctccctgccgtgcaggcagctcgaaagccactctgttgtggggtcctcgcttcccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagacttttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagtttttttttataattcagtctgcttttggattttcatatatttaactttgcaaaaagatttactttgtacatgttacaggcttgattggtgtaaatctttttataaatacataaataaaagaaaaatatgcatttttcttttctaaaa

SEQ ID NO: 12710 - DNA, 2827 bp, Homo sapiens
gcttcccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcttagctggcactgcaaatgtgaaagtaggatctcggacaccagtagaggcctctcatcctgttgaaaatgcatctgttcctaggccttcatcccattttgtgcgaagaaaaaagtcagaacctgatgatgagctgctgtttgattttcttaatagttcacagaaggagcctaccgggagggtggaaatcagaaaggaaaaaggcaagacacctgtctttcagagctctcagacatcaagtgtcagttctgtgaaccccagtgtaaccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagacttttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttaggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatcagggaaactaattgtatttagtgacaaaaataaaaagtttttttttataattcagtctgcttttggattttcatatatttaactttgcaaaaagatttactttgtacatgttacaggcttgattggtgtaaatctttttataaatacataaataaaagaaaaatatgcatttttcttttct

SEQ ID NO: 12711 - DNA, 2418 bp, Homo sapiens
ggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatcatgtcttggtttgttgatcttgctggaaaggcagaagatcttttaaaccgagttgatcaaggggctgcaacagctctcagtaggaaagacaatgccagcaacatatatagcaaaaatactgactatactgaacttcaccagcaaaatacagatttgatatatcagactggacctaaatctacgtatatttcatcagcagctgataacattcgaaatcaaaaagccaccatcaaaaccattgaagaaaattcttttgggagccaaacccacgaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacgaataatgcaggatcaaagtgaaggtaacagcctgcagaatcaagctctgcagacttttcaggagagactgcatgaagcggatgccactctgaagagagagcaggagagctataaacagatgcagagcgagtttgctgcacgccttaataaagtggaaatggaacgtcagaatttagcagaagcaattacactggccgaaagaaaatactcagatgagaagaagagggttgatgaactgcagcagcaagtcaagctgtataagttgaacttggagtcctctaagcaggaattaattgactacaagcaaaaagctactagaatactgcaatctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggatatggaggcacagcaagttaatgaagcagaatcagcaagagaacagttacaggatctgcatgaccaaatagctgggcagaaagcatccaaacaagaactagagacagaactggagcgactgaagcaggagttccactatatagaagaagatctttatcgaacaaagaacacattgcaaagcagaattaaagatcgagacgaagaaattcaaaaactcaggaatcagcttaccaataaaactttaagcaatagcagtcagtctgagttagaaaatcgactccatcagctaacagagactctcatccagaaacagaccatgctggagagtctcagcacagaaaagaactccctggtctttcaactggagcgcctcgaacagcagatgaactccgcctctggaagtagtagtaatgggtcttcgattaatatgtctggaattgacaatggtgaaggcactcgtctgcgaaatgttcctgttctttttaatgacacagaaactaatctggcaggaatgtacggaaaagttcgcaaagctgctagttcaattgatcagtttagtattcgcctgggaatttttctccgaagataccccatagcgcgagtttttgtaattatatatatggctttgcttcacctctgggtcatgattgttctgttgacttacacaccagaaatgcaccacgaccaaccatatggcaaatgaaccaagcccagttgttgcagtgattggttgtctttttctagacttgggatctgcaagaaggccaattgcctaaaatttctgagaacagtgcacaagattattttatcactacaagcttttaactttttaagttattgtacaagtattctacctaaatcttccaatttcctttaaatggtaagagtttctaaaacagacaataatttaacaagctcagctctgctttatctgagtttagtggtcctaatatatatgtagagaaagatggtggggttgttcacctctgtacagaccatctgtatgttaggtgacattgattatgggttataatca

SEQ ID NO: 12712 - DNA, 2894 bp, Homo sapiens
cggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctgggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttga

SEQ ID NO: 12713 - DNA, 5428 bp, Homo sapiens
ggcggctgcggggcgaggacggcggcggaccggggcagccccgcgccctggccaggaataattggtggggatggattgtgaaatggagctgcataaatatccagtttgccaactgagctaagaaatgctggataaaagtaaaagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcctgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaa

SEQ ID NO: 12714 - DNA, 6516 bp, Homo sapiens
ggcggctgcggggcgaggacggcggcggaccggggcagccccgcgccctggccaggaataattggtggggatggattgtgaaatggagctgcataaatatccagtttgccaactgagctaagaaatgctggataaaagtaaaagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccaactaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggtggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcctgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaa

SEQ ID NO: 12715 - DNA, 4335 bp, Homo sapiens
agttacgcagctgtcttccaggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggcttcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcctgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaagtgctgtttttgccttaaaattttattttgcgcatcttgaaaattatagtattaaaggtattgatactgtgcaaa

SEQ ID NO: 12716 - DNA, 4252 bp, Homo sapiens
atgttgccagttgatggggaagaaaggaagtcggagggctcagacactgagggggacagaacatctccatgtgcaggccctacatcatctgctaccctgaaggatctggaggtaggaggctctgggtggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcctgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtgcctctcactgatgttcactctggcatcctttagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttttaatgttattgcagcatggatgttcattacagaattcagataaaatttgctaatgttctgctatgatgtttgatctcatcttaatcacagtgagctcttccatagctcaatatgcggtttgccctcaagtgtgcactgtttattactttgtaatatgccactatgagtactgacacttagagctgtttaaaggccgagaactggaaacagcctttcctccattttctgtgtattggtgatgggagtgataaccttttgggggagctttctaaatctcgcagaagaggaaagtggcctgctctggcaggtatgtgcaggatacagtgtgtttcatctgttccggtgccaagaatgagcactgtactgtggcagttccctttggatttgtatgtgctctgggctcatgaagatattgcatcgtgagctgcagcagttgcactctttttcagtgacctaaaaatggcttatttccgaggaatgaaaggctgccatcgttggctgtggatgtggaaaacctttcctagcttagagcatttgtatctacaatacattttaaagtcagagttcgtgttccctgttttaatcacatgactacctgtcccagtacacgaaagggcgctggttggcattcttcttaatgtatttagtaaagatcataagacatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaactgaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttctgtgattgtgcctatgcgtgatgagtgaatgcatttcaatcatacattgcctaaatcataacttgatgatgcttgggaaagaatcaacagttaaaacttcatgaagttctaatgtctgtgttccaaaacacatcacattattaggttgtagggagatatgtatgtgtgctccctggggtggggagttttctagttactagaccatctccatttttagcacttggcagcctcatgatccttttataaataggagattaacaggagagcagcaatacgattttgccaatggaataacagatttgccggcattcactgaaagagggcagatattgggtccttgtgacttcaactgactcttccgaattgtatgaatttatcaatgtattagataaacccagtttcagaataataaagaaaaaatattagaccaaataatgtggctaatagtggtatgatttctagcccgtgggtttaaaactgtatcctaaagagtcattttaaaataatataaatatttaaaagtgtaactgctatctttatgttctgaaataagttaaaacattttaaaatatgaatactgtagtttaaaagaaagaaatggtgggaaggaaaagtagagaaagaaatgccaattccagtccaaagctttgtttgccaagttttcttagaatgaattttaccaatgtatgggttcttgttaacagaatgtgtaacagaaatactgaaagacttttgcctaaagtggcattattgactgctggtgtgatgctactgtaatgtgataaattattaaattgttgcaaa

SEQ ID NO: 12717 - DNA, 11187 bp, Homo sapiens
aactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaaga

SEQ ID NO: 12718 - DNA, 3395 bp, Homo sapiens
gagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttg

SEQ ID NO: 12719 - DNA, 280 bp, Homo sapiens
ggtctttagggcggagatcacagaatcattggagatattaatgcaaacggaggcctgtccaataatcctgctaatgctaatgggttactggaaagatgagaagagaggaaagatcccaacgatcccgtcaacacgaaaatcccaggaatcagagaaatgctgagccgattatcaggattagcaaatgttgttttgcatgaattatcaggagatgatgacactgatcagaatatgagggctcccctagaccctgaattacaccaagaatctgacatggaat

SEQ ID NO: 12720 - DNA, 4959 bp, Homo sapiens
ggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaa

SEQ ID NO: 12721 - DNA, 11198 bp, Homo sapiens
agtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagttgagttccatgcagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgagcaagcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggtgagtaaagagaaggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatg

SEQ ID NO: 12722 - DNA, 1699 bp, Homo sapiens
ggccggggaaaaacccggatgagctgggcagcagtgttggcagtcgcggctgcgagatttgggcacttttgggggtgccggtggcccgggccgatggcgcaaggttgggcaggattctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggtgagttggggaaattgaatctgaacaaggagtatgatttaattaatgtttattgccagctgttccaggggcttttatgtatatcatcattgaagcctcaaaacaaccccattcagtgctgtatttattcttcttttgtgctaattcaagtgtctcctcttcagtgaagtcttccttaactctgccctactagttaaccttgttcgtgtgccattagagcagttcttgcattatttatttacgttttagtctttgctgcgaaaccctcagctatttaatgtttggaagtgtttttgctcatctttcagcatctagcaaagtaaatatctgagtggtttcgccaaaactgttactctgacaccaagtctgtgttctttccattaaaatttttgatatctgatatagtcctataggattgaagtctagtcctcactttagctttcatcagagtaagaggatctagtttagtttttaaaagcttatgaatattttaagcatatcctctgtcttggaaatttgaaatattttctctttttttttcctttcaattatactctgtatgaaatggtttaatatatgtttccttggtttcaaccattggcattttttaaaagagaaaaaataccatggagtatttttaaaatgaactaacacatgtaatgaattacatggactttgcagacagataaaagggcaaaaaaatatgtccaatttcagggttttcagccctttcaacattgctttaatcatcctggtttgtcttttttcacaagggaatgctgtgttaatgactcagttttctatcttactctgttacactagaaatgaatcagaatgcctcattaggccagggtaaaccacaacatcagaatgtttatataacaatttattaaagcggaaatgcttgattgtggtttttaataaactgttgagtgtttaagaaa

SEQ ID NO: 12723 - DNA, 2189 bp, Homo sapiens
gcggccggggaaaaacccggatgagctgggcagcagtgttggcagtcgcggctgcgagatttgggcacttttgggggtgccggtggcccgggccgatggcgcaaggttgggcaggattctctgaggaggaactgaggagactaaagcagactaaagatccatttgaaccacagcgacgtctccccgcgaagaaaagtcgacaacaacttcagcgagaaaaagcccttgtagagcaaagccaaaaacttgggcttcaagatggatcaacctcattacttccagagcagctgctttcagcaccaaaacagagagttaacgttcaaaaaccacctttttcttcccctactcttccgagtcatttcactctcacctcccccgttggtgatggacaaccacagggcattgaaagtcagccaaaggaactgggacttgagaattcccatgatggtcacaacaatgttgagattctacctccaaagccagattgcaaattggagaaaaagaaagtggaattgcaagaaaaatctcgttgggaagtcctccaacaagaacaacggctaatggaagagaaaaataaacgtaaaaaagctcttttggctaaagctattgcagaaagatccaaaagaactcaggcagagaccatgaaactaaagcggatccagaaggagttgcaggctttagatgacatggtgtcagctgacattggaattctcaggaaccggattgatcaggccagcttagactattcatacgctcggaagcggtttgacagggctgaagcagagtacattgcagcaaagctagatatacagcgcaagactgagataaaagagcaactcactgaacacctttgtacgatcatacagcaaaatgagctccgaaaggccaagaagttggaggagttgatgcaacaactagatgtagaagccgatgaagagactttggagcttgaggtggaggtcgagagattgctacacgaacaagaagtagaatcaaggagaccagtggttcgtttagagaggccatttcagcctgcggaggagagtgtgacattagaatttgctaaagagaacagaaagtgtcaagaacaagctgtttccccaaaggtagatgaccagtgtggaaattccagtagcatcccctttcttagtccaaactgcccaaatcaagaaggtaatgacatttcagctgctttggccacatgaagttctggtattcttttgagctaatatggtattgagtaaagtatactttttgcagtagatcatgccctgacctccaataaaaacctctttaaaacaatgctgatttttgaattcatgattagttttagtaaattaataggtttggccattctaaaatccaaaattatgataactgtatttctaggggtatgtttcaccttgattttggcccggttctttcagtgttccgtttaccctttttactgaaagtaagtgacttaaaaggatggaagaaaaactacatggttggagtgtttttagatcagataaatatagaaaagtaaaatggaaaatgatactcaatacctagttaaactcatttcacttctcctgggagacgtattaagactggaagtcctattttatttaatcagtatcagtaaaaagacaaaaattacagtgtgaacaagagaaaaacaggaatagaagaaaaaagttgcaggttgaattatctatctggatattactagagttgtaaaacacaacttggaaactggaatttatgtgaagaaccaaacaacttaaaccagcatcacttttgtcttcaatttgccttccagtgattttagtttacaacctgcgttttgttatttgaaacacacacacttatatataaacacatgtaattttactattttattgtctttcctttaatcgatgaattgattaaatttagacaattaaaacatttctaaagtgagactgaaaataatatagaaaatctcattgctacttgtgattatcaaaaaaagtatgtattttctttctaaagttatctataaatatgtttttgatatgttggacatgaattaccctgtcatgaagcgtttaaattgttaaaatgctgattttcttattagtttgttaattgcctgttactagtacttgaccaatacattgtgctatatgtaaatgtgtaaataaatattgtaattttctcacaaa

SEQ ID NO: 12724 - DNA, 1599 bp, Homo sapiens
gatctccacgtcttggaggccgccggcataggtgtgcgcctggcagaacctcacaaatacacatgcacgcaggccccgactgaatccagggctgtaggggctaaagaggtctaggtcagtagaggcctgaagcccaggctggtctgtccaaggaaaaaggagcgtgattggtaccagatcttcgttccctgcagaaccttgacagttgaacaagtgacctcctccagaacagatggagagtctccagaagcagaggctttagtgaacgaaattcgcaataatcagctccagatcctgaaaaggagggcgaagaatcagtggccaaagctaaccgcttcatacccacacttcatcctcctcagtttctctccaggccaccatgtctgcaggcaacggcaccccttggggtcagcagcgggggaggaggtctgggctggatcaggagtggaggtggagggctcagagctgcccaccttctcggcagcagccaaggtccgagtgggagtgaccattgtgctgtttgtttcttcggctggagggaacctggcagtcctgtggtcagtgacacggcgggaacccagccagctccgcccctctccggtcaggagactcttcatccatttagcagccgccgacttactagtcacttttgtggttatgcccctagatgccacctggaatatcactgttcaatggctggctgtggacatcgcatgtcggacactgatgttcctgaaactaatggccacgtattctgcagctttcctgcctgtggtcattggattggaccgccaggcagcagtactcaacccgcttggatcccgttcaggtgtaaggaaacttctgggggcagcctggggacttagtttcctgcttgccttcccccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatgcccctgctggtgaatttgccctcccccgctcctttgacaattgtccccgtgttcgtctccgggccctgagactggccctgcttatcttgctgaccttcatcctctgctggacaccttattacctactgggtatgtggtactggttctcccccaccatgctaactgaagtccctcccagcctgagccacatccttttcctcttgggcctcctcaatgctcctttggatcctctcctctatggggccttcacccttggctgccgaagagggcaccaagaacttagtatagactcttctaaagaagggtctgggagaatgctccaagaggagattcatgcctttagacagctggaagtacaaaaaactgtgacatcaagaagggcaggagaaacaaaaggcatttctataacatctatctgatcctaacagagtatgtaggaacagaatagtaagtctttagtgccataagatcttaacatctcacttctactcctgctctcc

SEQ ID NO: 12725 - DNA, 1035 bp, Homo sapiens
ccgcttcatacccacacttcatcctcctcagtttctctccaggccaccatgtctgcaggcaacggcaccccttgggatgccacctggaatatcactgttcaatggctggctgtggacatcgcatgtcggacactgatgttcctgaaactaatggccacgtattctgcagctttcctgcctgtggtcattggattggaccgccaggcagcagtactcaacccgcttggatcccgttcaggtgtaaggaaacttctgggggcagcctggggacttagtttcctgcttgccttcccccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatgcccctgctggtgaatttgccctcccccgctcctttgacaattgtccccgtgttcgtctccgggccctgagactggccctgcttatcttgctgaccttcatcctctgctggacaccttattacctactgggtatgtggtactggttctcccccaccatgctaactgaagtccctcccagcctgagccacatccttttcctcttgggcctcctcaatgctcctttggatcctctcctctatggggccttcacccttggctgccgaagagggcaccaagaacttagtatagactcttctaaagaagggtctgggagaatgctccaagaggagattcatgcctttagacagctggaagtacaaaaaactgtgacatcaagaagggcaggagaaacaaaaggcatttctataacatctatctgatcctaacagagtatgtaggaacagaatagtaagtctttagtgccataagatcttaacatctcacttctactcctgctctcctagttccccccaaaaaagaaatactga

SEQ ID NO: 12726 - DNA, 425 bp, Homo sapiens
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggaagggccctggacactgcagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 12727 - DNA, 404 bp, Homo sapiens
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 12728 - DNA, 399 bp, Homo sapiens
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccg

SEQ ID NO: 12729 - DNA, 353 bp, Homo sapiens
gccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 12730 - DNA, 758 bp, Homo sapiens
gagaactcccctgaccatccatctatcctcccatccattggcctgaattcaggtctctgttcccctccaactttcttccacttctggaaactccttgaaggaaagatggatggacctggacaagtgggagggccctcagagctggcaaggcaggtagcctctgtgccccaggctcagggagaaggctcgtcccctggagcatcatcccctgctgggccaggatcccccaggatctggacccctgtatgcttgggatgaggagcggtggcagagagggaagggcataaggagataccaaagctgcccctgagatgccagttttccaaagtggccctggaggaagtagggggatgtgggggtgaggtaagtctccttgaatgctgtaccctgtccattagagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccgaa

SEQ ID NO: 12731 - DNA, 2164 bp, Homo sapiens
gcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagttatacatcttcaggatgattcatctagcagacagctctggacagacaaaagttttctctcaatgtgtaacacactgcagtttttcacaatggtggcatcaagcattttataactttttcaccttcagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtgattgatagactacacaagaagtcatatgaagaagggtaaggtaatgaatctctccatctgggaatgattaacacaaatgttggagcatgtttacatacaaacaaagtaggatttacacttaagttatcattcttttagaaactcagtcttcagagcctcaattattaaggaaaagtcttcaggaaaaatactaaaatattttctcttcctcataagcttctaaattaatctctgccttttctgacctcatataacacattatgtaggtttcttatcactttctctttgcataataatgtactaatatttaaaataccttcagcctaaggcacaaggatgccaaaaaaacaaaggtgagaaaccacaacacaggtctaaactcagcatgctttggtgagtttttctccaaaaggggcatattagcaattagagttgtatgctatataatacatagagcacagagccctttgcccataatatcaactttccctcctatagttaaaaagaaaaaaaatgaatctatttttctctttggcttcaaaagcattctgacatttggaggagtcagtaaccaatcccaccaaccactccagcaacctgacaagactatgagtagttctccttcatcctatttatgtggtacaggttgtgaagtatctctatataaagggaaattttagaggggttaggatttggacaggggtttagaacattcctctaagctatctagtctgtggagtttgtggcaattaattgccataaaataacaatgtttccaaatgcaactaagaaaatactcatagtgagtacgctctatgcatagtatgacttctattttaatgtgaagaattttttgtctctctcctgatcttactaaatccatatttcataaataactgagaataattaaaacaaaattaagcaaatgcacaagcaaaaagatgcttgatacacaaaaggaactctggagagaaaactacagcttcagtctgtacagatcaaagaagacagaacatgtcaggggaaggagggaaagatcttgatgcagggtttcttaacctgcagtctatgcacaacactatatttccatgtaatgtttttatttcagccctatttgtattattttgtgcatttaaaaaacacaatcttaagg

SEQ ID NO: 12732 - DNA, 859 bp, Homo sapiens
atggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtga

SEQ ID NO: 12733 - DNA, 3032 bp, Homo sapiens
aggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctcc

SEQ ID NO: 12734 - DNA, 3310 bp, Homo sapiens
aaagaagataactcattcaaggtcaatcagcaatgtctgaagaagaaagaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtacgccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctcca

SEQ ID NO: 12735 - DNA, 992 bp, Homo sapiens
aggcgtttgaggggctctcggagggaggtgacagggaggggtgcgtgtgcgtgcgtgtggggcttctgtgtccagaggtctgggggtgacgtcctttgttttgggcaggaggcgggctgggggcttgcgggacctgtgggcgctgcggggacgcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaatgtgagtaacaaattgtgaatcaaagcccgaatccccgtggaattcattccgaggctgattgcaatcacttggagtcgggcgcgtcctacctaaaccaggcagtttatggcaaatacctgccttgaccgtgcttaaattagtgaacttttgggcaccaactggtcgatttaccatagaaattggtagttgctgcaaaaagaaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttg

SEQ ID NO: 12736 - DNA, 904 bp, Homo sapiens
aggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacc

SEQ ID NO: 12737 - DNA, 571 bp, Homo sapiens
gcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaataaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaa

SEQ ID NO: 12738 - DNA, 3527 bp, Homo sapiens
cagtgcgcgcagcccgcgcggagccggctcagagcgagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatatgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaatatgtc

SEQ ID NO: 12739 - DNA, 3563 bp, Homo sapiens
gagaaaagcaaacccaacccgtcggggccgccgctccggacccgcagccgccgccgccgcctcctccccccggatcgggtgtactgtcccaacccgaaagtccagttctgcggcccggcagcggcgagcgggcgcgatgacacaggagtacgacaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatatgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaa

SEQ ID NO: 12740 - DNA, 3433 bp, Homo sapiens
ctgccaaaagaagtagaaaacaaacggccagtgttggttcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagccacatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacagagtctctgggaagctttaggacatctgctacgttatttatcaaaatattgggatctctgccttgtgcctacagtgtcgtgggcctgctcgctagcagaagtcagaaaaggcgataggcttggctttaaggatttcgtgcccttgcctgaattcagtacaactccactgcctcacgttagcgggagcgcacctgaagagtacggggggagccctctctcccttaccctctcactctccaccagatgtttactaaacagggcatgttactgaaatcttcctttgcgactttctcggacatatcaactgcctttctcatgaagaattttaatgggttacagtatgaaatcagttaagataaagctgcattgtatataagtgcaatatatttttgaaggtctgtaaatgtgtacatacatgtcttatataaatatataatatataaatatggtgtctgtgtacatatagtgaagatatgcagtaagagctaccttaaagactttccctagacaaaggttaagttattttttgatcgtgtataccaagcagatagaatactgtgcttagtggaacccgctaaaaacctttttctctgtttttccaaacacaggcattctgtagcatagcaaaaccttctcaaatgacagagattctgtttgctgttgagaatgttgttatttggatttctgcactgtttaacaaatgaagtaaaagaaaaacactactgcaatcacgtcttttgttatgctagtatcagtcagatgcacttagagtgaagaaacactgtaattacagcacacagattgcaagtattgcgtaccaagtgatacaactcgaaatgcagttctcatcttcctgttttgagaaatgattattttatcacgcatcagagccttcgtgctttgattatcttgtatgttaacaattctagaaaacattcatgaattcacaaaaatatgttactatggcaggggaacattttgtacacatttaagtatataaaaatactaaaatatgtaattttataacaaagtcacgggtatctttaggttcagggaactagactaggtcattcgtgtaaatggactggtagttacagtcttaggttaaagtattctaatgaagtatgggaactaaattgctggttttctaagataagatatgggatatgggtcatataacttttgtattttttatgaagttgattttgtcttgcgtgttatttttaattgtatcattgaagatgtattttaaaccaaaggaattaaattttatatgtctatttcgtaatatgtc

SEQ ID NO: 12741 - DNA, 5239 bp, Homo sapiens
tccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaagcggagcaagttcattggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgagcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagctgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctctctcacccctccatatctatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcttgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaataaatattcataacataagagtaaaa

SEQ ID NO: 12742 - DNA, 2140 bp, Homo sapiens
attggatcaaacatgtcacaagagtcggacaagtaagtggatcacacgcgccggctgctgctactactaccactttgggctgatggcaactgtaataaaagactagtggccttagtgcccatgcccagtgaccctccattcaatacccgaagagcctacaccagtgaggatgaagcctggaagtcatacttggagaatcccctgacagcagccaccaaggccatgatgagcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctac

SEQ ID NO: 12743 - DNA, 4901 bp, Homo sapiens
atggggaaagatggaaggagtaataaaagactagtggccttagtgcccatgcccagtgaccctccattcaatacccgaagagcctacaccagtgaggatgaagcctggaagtcatacttggagaatcccctgacagcagccaccaaggccatgatgagcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagctgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctctctcacccctccatatctatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcttgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgctgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtaggaaaaagacaaaagatttggcagcctgacacaggcaacctacccctctctctccagcctctttatgaaactgtttgtttgccagtcctgccctaaggcagaagatgaattgaagatgctgtgcatgtttcctaagtccttgagcaatcatggtggtgacaattgccacaagggatatgaggccagtgccaccagagggtggtgccaagtgccacatcccttccgatccattcccctctgcatcctcggagcaccccagtttgcctttgatgtgtccgctgtgtatgttagctgaactttgatgagcaaaatttcctgagcgaaacactccaaagagataggaaaacttgccgcctcttcttttttgtcccttaatcaaactcaaataagcttaaaaaaaatccatggaagatcatggacatgtgaaatgagcatttttttcttttttttttttaacaaagtctgaactgaacagaacaagactttttcctcatacatctccaaattgtttaaacttactttatgagtgtttgtttagaagttcggaccaacagaaaaatgcagtcagatgtcatcttggaattggtttctaaaagagtaaggcatgtccctgcccagaaacttaggaagcatgaaataaatcaaatgtttattttccttcttatttaaaatcatgcaaatgcaacagaaatagagggtttgtgccaaatgctatgaacggccctttcttaaagacaagcaagggagattgatatatgtacaatttgctctcatgttttaaaaaaaaaaaggtaaatgtaacttaatagttttgtaaatgggagagggggaatctataaactataaatacagttattttattttttgtacatttttaaggagaaaaaataaatattcataacataagagtaaaa

SEQ ID NO: 12744 - DNA, 236 bp, Homo sapiens
gagaaagttacctgtggccgcccaagtccgccactttctgctctgtgtctgcccattgccacgatccaggaggactccgcgccgcccggccgcctccgagctcgggccccatgtgaggggcccccccttatcccacctttccggctagacttgaaagtccagtttcaccagaggctgaggctccaggaaaagcggagcaagttcattggatcaaacatgtcacaagagtcggacaa

SEQ ID NO: 12745 - DNA, 4316 bp, Homo sapiens
cgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctca

SEQ ID NO: 12746 - DNA, 4484 bp, Homo sapiens
ctccaggctccagggcagcagacaccaccctctccgtgcctgctggtgttgggcggcttggaggctatggttcctgggtcctcgtagcacatcctggttctgggccaggacctgaaggagccacagtgaaagagtgtttctggatgtatctgagacagacggagggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaagtacaaggtcctgtctgtcctcccaggctcaggcatggggattgccgtgtcgacgccatccacccagaaaccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctcagcaccgcgtctgtaagggcctgcctgctgctctcggcctgacacgccggccaggaggtctgtagctggggaccagtaagggcacaggatggtgcaggtaaaagcacatctttctcacactttgctctttggaaggcccaggagaacatccgcgaaggctgttggaggtgctccgagcactgtggcatgtctggcacatggcccccaggctgcggttgcctgggttggttgggggaggaagtggggaggagtgttccgggaccatggtggcccaggctgcagccgcctttgggccatccgagaggctctggcagcccctgtgctttagggagcaaccgtgagccgagcccagaggcctgggcctgcactgcctgcagccgacatgcgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaa

SEQ ID NO: 12747 - DNA, 311 bp, Homo sapiens
ccgccgcctccgcgctcgtggccgggacccgcggggccgcctcctcccggctccccggcgccgctgggctcccgggcgggcggcaggcgtagcgcggccgggcggccggcgaggggggcgccgcggcgggtggatgagagttggccccgatatccgctcaggggaacccgagcgtcatgttagggtgaagcagaggacctcagtgctgaacatgctaaggaggttggacaaaatcaggttcagaggtcacaagagagatgacttcctcgatctagcggagtctccaaatgcctcggacaccgaatgcagcg

SEQ ID NO: 12748 - DNA, 2305 bp, Homo sapiens
ggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttc

SEQ ID NO: 12749 - DNA, 1661 bp, Homo sapiens
gctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttc

SEQ ID NO: 12750 - DNA, 1866 bp, Homo sapiens
gctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttc

SEQ ID NO: 12751 - DNA, 894 bp, Homo sapiens
attttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgatggaaaaagcaaaaattaacaaatatgtgactatccttcatctacctaaaaagggggacgatgtgaaaccaggaaccatgtgccaagttgcagggtggggcaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgta

SEQ ID NO: 12752 - DNA, 968 bp, Homo sapiens
ggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaa

SEQ ID NO: 12753 - DNA, 559 bp, Homo sapiens
atgcaaccaatcctgcttctgctggccttcctcctgctgcccagggcagatcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacct

SEQ ID NO: 12754 - DNA, 816 bp, Homo sapiens
ggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagactggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacct

SEQ ID NO: 12755 - DNA, 951 bp, Homo sapiens
ggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacct

SEQ ID NO: 12756 - DNA, 923 bp, Homo sapiens
gcaaggaggaaacaacagcagctccaaccagggcagccttcctgagaagatgcaaccaatcctgcttctgctggccttcctcctgctgcccagggcagatgcagacttttccttcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaa

SEQ ID NO: 12757 - DNA, 687 bp, Homo sapiens
cccatccctccttcatctccctccagcatttgtttctggaaggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaa

SEQ ID NO: 12758 - DNA, 909 bp, Homo sapiens
ggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaatatga

SEQ ID NO: 12759 - DNA, 522 bp, Homo sapiens
tttctggaaggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaaggggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcggggttgcaggactgtaataaatggatctctggtgtaaata

SEQ ID NO: 12760 - DNA, 947 bp, Homo sapiens
ggctcggggccggggccagcacccacactgggtctccacagcggcatggaggcctgcgtgtcttcactgctggtgctggccctgggggccctgtcagtaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctc

SEQ ID NO: 12761 - DNA, 5488 bp, Homo sapiens
cctctgcctggggccccagggatgcgcctcctcctgaaagtcccctccatcctcccttagaggaacaggctgccgccgcgcccccatcagcctccattgccctgaccttatttccacctgatggtgccagaggctgcttcccagctggtatcctgagatcctcgttcccttggtggcttggttgtttaagcctccattattgattgggggcggtggtctgggtgtgattcctgtgggggaaaccagcccgaggtgccttggctcaggcttgcctgcctggagtccttgtcgtgtacccgtctgtggccctagagtcacctcctgctccttttcactgggtttctccccagaccaagcccctggatttgagcttctgagcagccaactgatttttttcatgagggaaagaattttgctcctagatttatttctaatccttttctccgtaactgaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcagggcagggctgccggcagagccatgtcctgaaccctccctcctcccccctgctctccttaagggtctttcccagatgtgaaggtccctcccaggctctactgaggtcagaccaattcccagtggcttgggtaccctcgttcactccagcaccagcccctgccctccttcttcccgggccaggctgccaggtgagccccgggccaagggtggttgccctgctgaggccgaaaggactcgagcttcccatctcctcgcctcccccaggtctttcaccgtctggactcatctctgggtaactcatggtgtgagtggccacgtggctggctcaggtgagtccttttagaccccaggtgacccaccagctagtccggggcccattgttgtgcccactaggatgtcccccatggtgtcctccctgcgctttaaagttctccttcgtgtgctgttcttcatggcccctgttcccccacaggtgtttggacagtgaacgccaggtcccctcctccccacccccggcctctcaaacacgcccagccccacgatggcagcagagacactcaactttgggcctgagtggctcagggccctgtccgggggcggcagcgtggcctccccacccccgtcccctgccatgcccaaatacaagctggctgactaccgttatgggcgagaggaaatgctggctctctacgtcaaggagaacaaggtcccggaagagctgcaggacaaggagttcgccgcggtgctgcaggacgagccactgcagcccctggctctggagccgctgactgaggaggaacagagaaacttctccctgtcagtgaacagcgtggctgtgctgaggctgatggggaaaggggctggcccccccctggctggcacctcccgaggcaggggcagcacgcggagccgaggccgcggccgtggtgacagctgcttttaccaaagaagcatcgaagaaggcgatggggcctttggacgaagcccccgggaaatccagcgcagccagagctgggatgacagaggcgagaggcggtttgagaagtcagcaaggcgggatggagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaagaagggccccaaggagcccattcctgaggagcaggagctggacttccaagggttggaggaggaggaggaaccttccgaagggctagaggaggaagggcctgaggcaggtgggaaagagctgaccccactgcctcctcaggaggagaagtccagctccccatccccactgcccaccctgggcccactctgggggacaaacggggatggggacgaaactgcagagaaagagcccccagcggccgaagatgatattcgggggatccagctgagtcccggggtgggctcctctgctggcccacccggagatctggaggatgatgaaggcttgaagcacctgcagcaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccacagtgcgcgctccgagaaaaggcagctctgggggacctgacaccgccaccaccgccgccgccacagcagcagcagcagcagctcacggcattcctgcagcagctccaggcgctcaaaccccccagaggcggggaccagaacctgctcccgacgatgagccggtccttgtcggtgccagattcgggccgcctctgggacgtacatacctcagcctcatcacagtcaggtggtgaggccagtctttgggacataccaattaactcttcgactcagggtccaattctagaacaactccagctgcaacataaattccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgcggcagcaggagctattgctgaagttgctacagcagcagcaggcggtccctgtgccccccgcacccagctccccgcccccactctgggctggcctggccaagcaggggctgtccatgaagacgctcctggagttgcagctggagggcgagcggcagctgcacaaacagcccccacctcgggagccagctcgggcccaggcccccaaccaccgagtgcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttatttttttttttaattttaaacgactgaagaaaacattaggagaggcaaaaatattgttaaaaactagactctaaacaccccttcctgctgtgaggatagtgggtgtgacaatggaaggtccacagaggtttttgttttttggttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagtggccccagctctctggctgccatcttgtgctggccgagtagacgggaggggccaagccgtgccaacctctctggctggcagggtggggcagcaggactctggttctggtgaggggcgtctcccactgctgccattttgggggacaccctgggtttgaacctgaaagccccagctctctgccttgccacgtgaatgtattctttgggccacaagcccccgcctcacccctgcctgagctgcctcacccctgtgagcggcgggggtggatgattgctccagaggctgcagagagaaggctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtgg

SEQ ID NO: 12762 - DNA, 4477 bp, Homo sapiens
tcgagcttcccatctcctcgcctcccccaggtctttcaccgtctggacgatgaggatgaagaaatgggcacctttgatgcctctggggccttcttgcctctcaagaagggccccaaggagcccattcctgaggagcaggagctggacttccaagggttggaggaggaggaggaaccttccgaagggctagaggaggaagggcctgaggcaggtgggaaagagctgaccccactgcctcctcaggaggagaagtccagctccccatccccactgcccaccctgggcccactctgggggacaaacggggatggggacgaaactgcagagaaagagcccccagcggccgaagatgatattcgggggatccagctgagtcccggggtgggctcctctgctggcccacccggagatctggaggatgatgaaggcttgaagcacctgcagcaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccacagtgcgcgctccgagaaaaggcagctctgggggacctgacaccgccaccaccgccgccgccacagcagcagcagcagcagctcacggcattcctgcagcagctccaggcgctcaaaccccccagaggcggggaccagaacctgctcccgacgatgagccggtccttgtcggtgccagattcgggccgcctctgggacgtacatacctcagcctcatcacagtcaggtggtgaggccagtctttgggacataccaattaactcttcgactcagggtccaattctagaacaactccagctgcaacataaattccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgcggcagcaggagctattgctgaagttgctacagcagcagcaggcggtccctgtgccccccgcacccagctccccgcccccactctgggctggcctggccaagcaggggctgtccatgaagacgctcctggagttgcagctggagggcgagcggcagctgcacaaacagcccccacctcgggagccagctcgggcccaggcccccaaccaccgagtgcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttatttttttttttaattttaaacgactgaagaaaacattaggagaggcaaaaatattgttaaaaactagactctaaacaccccttcctgctgtgaggatagtgggtgtgacaatggaaggtccacagaggtttttgttttttggttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagtggccccagctctctggctgccatcttgtgctggccgagtagacgggaggggccaagccgtgccaacctctctggctggcagggtggggcagcaggactctggttctggtgaggggcgtctcccactgctgccattttgggggacaccctgggtttgaacctgaaagccccagctctctgccttgccacgtgaatgtattctttgggccacaagcccccgcctcacccctgcctgagctgcctcacccctgtgagcggcgggggtggatgattgctccagaggctgcagagagaaggctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccc

SEQ ID NO: 12763 - DNA, 5847 bp, Homo sapiens
gacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaa

SEQ ID NO: 12764 - DNA, 7878 bp, Homo sapiens
gtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtaggaaagaagaatggatattattgcatgtactcaccagttcttttgctgggtcagcctttatgccaagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattctatctgagtgcacctcttgtactcacctttatggaggctgagttctgcactaaactgttcctcttggtaccatggaaaagctccaagcacccaagacatggaggcagccatggcttctttctctgccagaccacgtagcactggctggttctgtatttgagaatgtagaggtcaaggcagatgtcggtaagtttgaccaaatatcttttctctttttgactctccctttctgctaacatgtggatcagctcctgccctcataccgcagacacacccactctgaacacacccctccagagcttgcccacaccttcccaactagactctgtgtgtgtattcaggaaaaatgaaaataaatttttaaaaattgggagtggaatgggcagattagggggaacaaagtcattttggtcatggaacatccatttgcttaaccaaggagacttgcttctatctgaggaatttcccacttagtagaaagaaacactcttccctgggaatgtttgtttctgtctctctcaatgctactctctttcatattctcatttgctcaccctttcacttagagccaccgttttctcatcccattctatgaacttatttccaaattctcctaactattcctgagttttgaagtatttgttttgtaccctctctgcttccggttttttgtttggttggcttttttggagatagggtcttgtgatgttgcccacactggtctcgagcccctgggctcaagtgatcctcccgcctcagcctcctaaatatctaggactacaggtgtgtgccaccatgcccagctccagttttgttggttgatttgtttaaattcagagatttaaaaacatcccagacaagacagtttgattatggagactgtccccaagcagattggtgtgctggtggctgctgtgcataacagattccctccagattggcttacaacagctacttcattctgtgggtcaggaatttggatagggctcagctgggtggtggttctcctggggtattctttggttgtggtcagatgtcttccagggcatcattcctatgaaggcttaatgaattaggcaagctgtccaagatggctcactcgtgtaatgacagttgacgttggctgtaggctgggaactcagctgggttgatgactggaggagcttatgtgtgtcgtctccggaatggcagcttcagaggagttgaacttaagtggtgattggcttcccccagagaaccaggcagaagctgtgttacctttttgagctcttagctcaggagtcacatagagtcacttctgtgacactgtgttgcatcaaagtagtcacaaacccactcagattcaagagaagggagcatggccctctccctgcaaccccctccccccccgccttgatgaaaggagtgacaaggtcacattggagaagagcttgtggggtgggagatattatagccatttttgggaaatatctgcataaaatgagtttatgcatacatgaaggactttattttcattggctttaagttgagggtttttgtttttgtttttgtattggagatgggttcttactatgttgcccaggctggtctcaaacccctgggctcaagtgatcctgttgcctcagcctcccaagtagctgggactacagctatgtgccagtgcacccagcttgttttttttaaattttaggatagataatggtacttctggctttatttaaataatttttttagggaaaccattgtatttatacatgcatatatttttatatatacaaatatgtatataaaagtatatgttttacattttcaatatatatataatatatacatatatgttatatacgtatatatattgcaccctactttaaaattgactgataacaaaattggtaattttgtataaaatgcccaactgtgcattattaataaaagtatgtgaatgactct

SEQ ID NO: 12765 - DNA, 5976 bp, Homo sapiens
gtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtaggaaagaagaatggatattattgcatgtactcaccagttcttttgctgggtcagcctttatgccaagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaat

SEQ ID NO: 12766 - DNA, 5978 bp, Homo sapiens
atcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 12767 - DNA, 7641 bp, Homo sapiens
gtgacgtgcgtggcgacgtgtcggccatcttgtgttgttgaggctgaggactgactggggttctgagactccctgtcccggaccgcagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattctatctgagtgcacctcttgtactcacctttatggaggctgagttctgcactaaactgttcctcttggtaccatggaaaagctccaagcacccaagacatggaggcagccatggcttctttctctgccagaccacgtagcactggctggttctgtatttgagaatgtagaggtcaaggcagatgtcggtaagtttgaccaaatatcttttctctttttgactctccctttctgctaacatgtggatcagctcctgccctcataccgcagacacacccactctgaacacacccctccagagcttgcccacaccttcccaactagactctgtgtgtgtattcaggaaaaatgaaaataaatttttaaaaattgggagtggaatgggcagattagggggaacaaagtcattttggtcatggaacatccatttgcttaaccaaggagacttgcttctatctgaggaatttcccacttagtagaaagaaacactcttccctgggaatgtttgtttctgtctctctcaatgctactctctttcatattctcatttgctcaccctttcacttagagccaccgttttctcatcccattctatgaacttatttccaaattctcctaactattcctgagttttgaagtatttgttttgtaccctctctgcttccggttttttgtttggttggcttttttggagatagggtcttgtgatgttgcccacactggtctcgagcccctgggctcaagtgatcctcccgcctcagcctcctaaatatctaggactacaggtgtgtgccaccatgcccagctccagttttgttggttgatttgtttaaattcagagatttaaaaacatcccagacaagacagtttgattatggagactgtccccaagcagattggtgtgctggtggctgctgtgcataacagattccctccagattggcttacaacagctacttcattctgtgggtcaggaatttggatagggctcagctgggtggtggttctcctggggtattctttggttgtggtcagatgtcttccagggcatcattcctatgaaggcttaatgaattaggcaagctgtccaagatggctcactcgtgtaatgacagttgacgttggctgtaggctgggaactcagctgggttgatgactggaggagcttatgtgtgtcgtctccggaatggcagcttcagaggagttgaacttaagtggtgattggcttcccccagagaaccaggcagaagctgtgttacctttttgagctcttagctcaggagtcacatagagtcacttctgtgacactgtgttgcatcaaagtagtcacaaacccactcagattcaagagaagggagcatggccctctccctgcaaccccctccccccccgccttgatgaaaggagtgacaaggtcacattggagaagagcttgtggggtgggagatattatagccatttttgggaaatatctgcataaaatgagtttatgcatacatgaaggactttattttcattggctttaagttgagggtttttgtttttgtttttgtattggagatgggttcttactatgttgcccaggctggtctcaaacccctgggctcaagtgatcctgttgcctcagcctcccaagtagctgggactacagctatgtgccagtgcacccagcttgttttttttaaattttaggatagataatggtacttctggctttatttaaataatttttttagggaaaccattgtatttatacatgcatatatttttatatatacaaatatgtatataaaagtatatgttttacattttcaatatatatataatatatacatatatgttatatacgtatatatattgcaccctactttaaaattgactgataacaaaattggtaattttgtataaaatgcccaactgtgcattattaataaaagtatgtgaatgactct

SEQ ID NO: 12768 - DNA, 564 bp, Homo sapiens
atcttgtgttgttgaggctgaggactgactggggttctgagactccctgtcccggaccgcagcgttaaaaggatctgaacaaagtctgctcaaatctcctgctgtgaaccagcagaatttttgaacagatgctgcttgaatctggggcttcgtttatatttcaagactgctgcctgtaggagctccatctgtatcatttgtgttaatagtgaccctggagttttgtacttccagaacctatgtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttcca

SEQ ID NO: 12769 - DNA, 588 bp, Homo sapiens
atcttgtgttgttgaggctgaggactgactggggttctgagactccctgtcccggaccgcagcgttaaaaggatctgaacaaagtctgctcaaatctcctgctgtgaaccagcagaatttttgaacagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgc

SEQ ID NO: 12770 - DNA, 530 bp, Homo sapiens
gtgacgtgcgtggcgacgtgtcggccatcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacagagatactgtagctaagtgcaacaaggtgtcctgaattggagactggcacagaacaaggatgttgttggaaaaactgatgaaatctgaataaactctgaagtatagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaat

SEQ ID NO: 12771 - DNA, 544 bp, Homo sapiens
acgtgcgtggcgacgtgtcggccatcttgtgttgttgaggctgaggactgactggggttctgagactccctgtcccggaccgcagagaccacgtctccacctcctgggctccaacgattctcccatcttggcctcccaaagcgctggatttacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtggggg

SEQ ID NO: 12772 - DNA, 606 bp, Homo sapiens
ggactgactggggttctgagactccctgtcccggaccgcagcgttaaaaggatctgaacaaagtctgctcaaatctcctgctgtgaaccagcagaatttttgaacagatgctgcttgaatctggggcttcgtttatatttcaagactgctgcctgtaggagctccatctgtatcatttgtgttaatagtgaccctggagttttgtacttccagaacctatgtgagcatatgtgatggccttgtagtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggac

SEQ ID NO: 12773 - DNA, 561 bp, Homo sapiens
atcttgtgttgttgaggctgaggactgactggggttctgagactccctgtcccggaccgcagagactgtctcgctctgtcacccaggctagagtgcagtggtgctatcgtaactcactggagccctgatctaggctcaaaccatcctcccacctcagcctcccaagtagctgggactaaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagt

SEQ ID NO: 12774 - DNA, 2913 bp, Homo sapiens
tcatgctatctttatcagtttccaaaggaacgtttaaagttagttccgaagtagtcttcctgatcatgtgtgcaagacttcatgaccaagctcccagatgatccagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagaggaatcctcagctagcttctgtttttatgcaacagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcag

SEQ ID NO: 12775 - DNA, 2675 bp, Homo sapiens
atcttgtgttgttgaggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggtgggtaagagggatagttaaaatgtttacaaaactttaggctccctcggaacttttgccagtgtggaggaaaataaaaaagaacttaaat

SEQ ID NO: 12776 - DNA, 5747 bp, Homo sapiens
gttgttgaggctgaggactgactggggttctgagactccctgtcccggaccgcaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaataaaatctgattgtattcta

SEQ ID NO: 12777 - DNA, 5937 bp, Homo sapiens
ggctgaggactgactggggttctgagactccctgtcccggaccgcagattatagtgggaccagtctcattaggttgaatctacagcctatgttggtgttaacccaggtctcttagagcgttaaaaggatctgaacaaagtctgctcaaatctcctgctgtgaaccagcagaatttttgaacaggtttcttcacatataaaaatctattgtaaaaatacggaaaagaatggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagagaaacttttccatgtctgtaaatagtgctgctgtcctgcgattgacaggacgaggaggaggaggaacagtggtgggggctcctagaggtcgaagttcttcaagagggcgaggcagaggcagaggtgaatgtggtttctaccaaagaagttttgatgaagtagagggtgtttttggtcgaggaggtggcagagaaatgcatagatcgcagagctgggaggaaaggggtgacagacgttttgaaaaaccaggacgaaaagatgtaggaaagaagaatggatattattgcatgtactcaccagttcttttgctgggtcagcctttatgccaagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctgatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaaaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttgctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatgaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcagcaagctgagaaaatggtggcttatctccaagacagtgcactagatgatgaaagattggcatcaaaactgcaagagcacagagctaaaggagtgtcgattccattgatgcatgaagcaatgcagaagtggtattacaaagatcctcagggagaaattcaaggtcccttcaataatcaggagatggcagaatggtttcaggcgggctattttactatgtctttattggtgaagagagcgtgtgatgaaagcttccaacctcttggcgatatcatgaaaatgtggggaagggttcccttttctccaggtccagctccccctcctcatatgggagagctggaccaggaacgactgaccaggcagcaagaactcacagccttataccagatgcagcacctgcagtaccagcagtttttaatacaacaacaatatgcacaggttttggcccaacagcagaaagcagcactgtcttcccagcagcagcagcagttggcacttcttcttcaacagtttcagaccttgaagatgagaatatctgatcagaacatcattccctcagtaactaggtctgtgtccgtgccagatactggctctatctgggagcttcagccaacagcttcacagcctacagtttgggaaggtggtagtgtatgggatcttcctctggacaccacgacaccaggccctgccctggaacagcttcagcagctagagaaggccaaagctgcaaagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggaagaggaggctgcaaaatgggcccgggaagaagaagaagcccagcgtcgattagaggagaaccggctgcggatggaagaggaggcagccagactccggcatgaggaagaagaacggaagagaaaggagctggaggtccagcggcagaaggagttaatgcgccagaggcagcagcagcaagaggctctccggaggttgcagcagcagcagcagcaacaacagctggcgcagatgaagcttccttcttcttcaacgtggggccagcagtccaatacaacagcatgtcagtcccaggccacgctgtcgttggctgaaatccaaaaactagaggaagaacgagaacggcagcttcgagaagagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacgcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatgttcccacatttgtttctttcctgaaagaagtagaatctccttatgaggtccatgattatatcagggcctatttaggagatacttctgaggccaaggagtttgccaagcagttccttgagcgccgtgccaaacagaaagccaaccagcagcgtcagcagcagcagctgccacagcagcagcagcagcagccgccacagcagccgccacagcagccacaacagcaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggattttcagtcaatgcatcatcggagcgactcaacatgggtgaaatcgagacgttggatgactactgagcacctgccagtggactggccatccctctcctgtctgccgactatggagtctccacctttggacacaacacttactcaccatttactctttatcactctgcaacaaatcacagaaccgatcatctcaggctttttcttctggccctttgtgtccaagattctttaatccatttttgttggtgaacatctcagactatagataagtggactggaccctgtgtcttgggggtggcagttgggattactccccaacaaggctgattttaggcagcatgtgttcactgtgctgtgatttcatctactgtctcccagaaagtgtgttgggatcggccattagcagcttgctttctcttgtcactttttttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttggcttctatttttattattttggatcaccattctccctatcccttcttgcctccctcccttctaaacatgtgtaataactatacagagactgctacaaaattgtatatagtttttggatcaaatagcatgaggggagaggaaaccattaaaagttggggctcctactctcctttgctttgtaaattcaaaagttgggggtgggtaagagggatagttaaaatgtttacaaaactttaggctccctcggaacttttgccagtgtggaggaaaataaaaaagaacttaaat

SEQ ID NO: 12778 - DNA, 2648 bp, Homo sapiens
gagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcg

SEQ ID NO: 12779 - DNA, 7981 bp, Homo sapiens
gtgtgtgtgtgtgtgtgtgagcagcgctgtgtctgtttcggaaagcgctctggggaggtcttgtccctagggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtctgctccggatggctccgcaagtcccccccggagaaaaagttgaagcgttatgcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtcaaagtcctaaaattttaagactcaaaccccatggtttagagcgaactgattcacaaaccataggtgactttgctacaagaagaaaggtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcatttttttaaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttgaagatctgtagcactctgattttcagaaaatttttcattctgaataatttaaaaatggtgatgtattagaaaggcagtttgctttagaaaactaaatcacattgaacattgtattagagaattaaattaaaagtttcttacagagcagtattttccaaacatttttagcactagaatctttttagatgaaattttatgtataaccccaatacataaagcctgaaaactcaattttatcaatataaatgtattttgggttcacatttatgcttattcattttggctcattactaagcataataagattctgagttatttctgaataacacaaatgtggagttatacatagttgatgaaaccagcagccaatttatagctatgccctgttttatttgtatactatcaagaaaattttgattcacacaaatgtaagcaaaaataataggttttaaacatacatctcaggaaattctttaattagagatagctaaagttattcaaggtctatacaaaaataagttatcctggtagtggaagttaatacataagcagtctccagtgtggtaaagtagggtatgtaacacatcagaatgtgcgtttttattaggttttaaaatatgcacgtataaaaactaaatttgaatcaaacccttttaactcacctccaagaagctagactttggccaggaatgggctaaaaaccactggttaacgatgtgacagttatgatcttggagattggaaatctttcttccacattagagttctttaccttaattccttattctgaaaaattgtaagattttatgaaggtttgaatactgaagcacagttctgctttcaaaaattaaaattcaaacttgaaaaagctgtttaacccatggaagatatcatttagtaagatgtaaaagattttttaaatctacacttcagtttatacatctttatcattatcaatactatataagttactgtgagcattttagagaattccataaaggtactatgagtgtgtctgtatgtgtgtgtatatatagcattgtatttaatcatagactaaatttaatttgatatagaaatactactttacttgtacattaaggtcataatttctgctggactcttttatatttaattaatggggattatagtcttccttcataaatgcatttaaacctgaaattgaacaccagtgtttttctttttctacttatgggaagttgtctgcttccccctttagagaaaacagtatttttatattttgttaaaatattaactactttatgcctacacactatgctgtagatactgatcataattcttgggtgttcacaaacactcctagtgcctcttttttggcccgttgaaagtgttggtattactactttcactacagagcctttggccctctaataatgctgaggtgggctgatccttcccatttctgtcttcgggtcattctggtaggtcttctcctccactgtcaagtaagcaatcaggtccgtgacagggattggacatatgaacaaattaagtggatacacacagtgagaaagatacatgcattctatggtaacaactactgtcaataacatctgatgttacatgcacatttatatatatataattttaaaaactgaactatgagaagccatggtataaatgaatattgtggacatcatggacttgatatgatagaaatcaattgtcagcttgagaaagttgtttttaatctgtctaaatagttcatgcattactacagttaaaaatagtttcatttgtcttctatagacttaattttattccggttcagtataatctctgttaacagagtttcagcaaactgattggtcaaggtattaacatagcttctacttcctttacttaaaaagatgtggttttatgtaagttcttgattactgatgatcatcccaaattttgacaacaaaatcatatgtataaatttatttctcccctcttgttcatcatcttttgtaaaggtcccattgtagatcttttctgctaccaaataaaacttttcaaacaatttggtttcaagaccttaaatagacaagttggatactaagattgtgaactgataaggacatataaatttatatttccagcccttccttagagtctttatctgcatcaaaaacccaattctgccattaactgtgcttcccagtcccacctctatatgtcactcattttctgcaacaaagatctcactaaatcatgttgaaacacaagtcatgatcctctctaagtaaatagaaaaagctccctggaaaaactctgttgccacatgcacgtgccctgttactcctccagccagccagtgctgccagcattttattgtgtaaaagtccaaataaataagggcctgcatgcaacctttatcttcagaaactaggttttatatgtaaaatgtgacttgggaaatgattctgtttattaactggctgggatttttcatttctatgaaagtttcaaacatctccagtactttataaaatcccaacaattgctgtaagtcagcactttggtccactcagcccacccagcccacttgcaactctgactcttcactgaatcatatttgggaagtttgggtagggtgaggctatcttcttcaagattattttctcatatgtctgtctgtcaccttgtaaaccatgagactcctgggtatttgcatgtaacttctttgaggaagttaccaccatctctgatatagacacactttttgagttgcagtttctgttagaattttttggagactaacttgccaattctgtgaatgttattgaatatttaaaaagctgggtctgtaatgggaggcattttattagctgttgtgattgggtaacatgtccccttagatttcctgatttaaaattatacaaaattactatttttgataaaataaaggaacacctacagaaaattaagtttctaagatgtttctatacttcattagaaaagattttattactattacttatggttattggtgattaacacttaatgcgtctcctctgattttgtgttccatgaggtgcttggaacatttggagtgctctgtgcgagggacatacagtgatataggaaatttaaaaattaaaataatacccaaaacccactttatcagatatggtattgtgatggttaatattatgtgtcaacttggtgaggctatggcgcccatgtgtttggtcaaacactagcctagatgttgctgtgaatatattttgtagatgtgattaacatttacaatcagttgattttaagtaaagcagattctcatccataa

SEQ ID NO: 12780 - DNA, 2477 bp, Homo sapiens
attactttcctagactctagtcatgaacaggatgttggaagtcagaggtacagagaagctgcctttttaggccgctcacatgaaaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccagaacgcatgctgattctgcaaaatccacctcttctgaaacagactgcaatgataacgtcccttctcataaaaatcctgcttcctcccagagcaaacatggaatgaatggcttttttcagcagcaaatgatatacgactctccaccttcacgtgccccatctgcttcagttgactccagcctttataacctgcccaggagttattcccatgatgttttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaagatgctagttctcaagactgctatgatattccacgagcatttccaagtgatagatctagttcacttgaaggcttccataaccactttaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaagtcaagccagcgcctttagaaataaaacctttgccagaatgggaagaattacaagccccagttagatctcccatcactaggagttttgctcgagactcttccaggtttcccatgtccccccgaccagattcagtgcatagcacaacttcaagcagtgactcacacgacagtgaagagaattatgttcccatgaacccaaacctgtccagtgaagacccaaatctctttggcagtaacagtcttgatggaggaagcagccctatgatcaagcccaaaggagacaaacaggtggaatacttagatctcgacttagattctgggaaatccacaccaccacgtaagcaaaagagcagtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataaca

SEQ ID NO: 12781 - DNA, 6052 bp, Homo sapiens
gaaattttgagaagtggtgggatgaagaagatccctgaagagaggagtaactgagacaaaggcgaggctagcaatagagagacaagtgagggaattagacctttggtatcatcatgaaaaggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccc

SEQ ID NO: 12782 - DNA, 6092 bp, Homo sapiens
gagctgcgcaccgccggccgctgccccagctgcccgagcccgcgccctcgtccgcgcgacccggcggggggctccaggccggcagcatgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaacaaaaggcctttgagcatatgggtccagccactcagaagtgtaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcacccc

SEQ ID NO: 12783 - DNA, 543 bp, Homo sapiens
gtagtaggtccgtctcctcctcccgccgagggacgccagagttaaggagcttcttgctgggaaggggtccctcctttcagccggaacctgacccgcagaatgtatcggaaatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactct

SEQ ID NO: 12784 - DNA, 567 bp, Homo sapiens
agctgcccgagcccgcgccctcgtccgcgcgacccggcggggggctccaggccggcagcatgagcggcggcggcgacgtggtgtgcaccggctggctgaggaaatcgcctcccgagaagaagttgaggcgctattaccttctgtctgacttcaaccccacatctgcttgacaagaattaactcaaatatctcttcttaacacctacctgattctggcatacagcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctct

SEQ ID NO: 12785 - DNA, 3893 bp, Homo sapiens
acagactgcagggctgactagggttagtttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggccttcagctgtcactgcttcctccttgtcttgggaattttcacggagaacagctaagcagagaccacacctcggcactggacacagaacaacagggtggggttgaacttggtggggcacgttctagctgacctgcaagccccgctcacctggagggcttgcagagcagctctcctcctgttctccaaggggtgggcactgttgcattaggaattaaggtgcagcccagtgctgcgggcagccaagcgagtctgagcggggatgtgaaggcaggacggggttggagagaccctgcctgtgcaaggctggcctcctagtcaacacctagctgagacattcatctctgttcaaattaatattccttgggtctttcaaatgaatgtttcaatgtgaggagcgaagtactgggaaatcgagggattttccacaatccccaagcagcttactcagtggaacctctgtttccccagctatgaaggaaatagcatcctacattccgtaaagtgcttgaagaagctctagctgagaatgctgaattttacagtcattgttttatggttacaagggtatgtcttcagggctctgttcattttccctcttgattttctcttttgaagatgccttgcccagtggcatggaaagaagcccacttgatgataggagcctgactatgaattgattgactaaacatgaccccaggtggaagctggctttgacaccagcttcctgttcagtctgaccactgctgtcctcctgctgcccaagagttgcacctggagcaaggaaccccaccatggctgtcgctctccatcccatcacgctagaatcatgtgtccaagggctcactctggaggtgcacagcacaggtcagcctggccaggggcgaaggagacagtagagaggaagctcagggccttaggggaggccgggtgcaaacccgttctgcaccaagtgcactcggagtttgtgggtatgggtgtgtacccctgcaggtgtgcacatgtgtgcttgcacgcacatatttgtgcactcctgtgtgtatacatgtgtgcttgtgtatgcatatgtgtgcattcctgcatgtgtggacatgtgcgtgcatgcatctgtgtgtctgtgtgtgtgctgagacaggaaagggggtgaaagtgttggtgagggagcctggaagttttctcttccccaacctctcttgctctaaggagggatggggttgggggcagccgttattgaaggtgatcggagaagaaagattttctgactcagaagtgactgccagtgtagcacaagcagtgtcccttgtgactgtgattctacagttctctgatcctcatgtttcctttagaggaaagaggaaaaaaggaactctgtggtgggtattgggagggaaaagaaaatagcctggtggaggcaggagggagtcgagtgtgagtaaggagcacctgcagcttttggaagtgaaagcagagagagggaaaggtagctaagacatccaggaggatcaaggggcagcgtgagaggcacagggggaggaaagggagagggtgagtggggccagggaagagaacggtgtggagttggtgggcagatggtgcaggaggagggctgggcagtggggagaggaagaatcagagcagagaaaccgctgctgcggaaggcagggagcaaagaagcataaggaaaagaacaggagaaagaacaaaggcagagaagacctcctcagctattttggtgctaggtaatgtgaaatgctgcagtaaataaaagccataagtaatgtttgattttacagtatttacaaaccatatgctttaaacagcccacaaactccatccagttgtctgatgatgtgggaggaccagctctagttagacggaggtatgtgattcgattctggtggagactttgtgccttgaaaggcttctcaggaaagcagtaataaaacaaagtgtccttgtttggccaggccgtgtctggtgtctgcgttgcatacccctcaggtagagagtgagaacgagaccagggggtgacaggggtcatcggcctgcaggagctgaccccgtaggcaggcggtatgagcagagctttcagaacccctggagctcggtgttctgttgtagcaaaagctactgaagagtattttgtactgagatgccaaagcatctttcccttgctcatcagcctccattcagaaggaagcgggaaagtcacccaaaccacctacaaggaatgagggctcttagcggccaggtaaagaggacaagaaccaaactgtccacattatggaggggagggggaaagagagctcaacccccctcagcctctggtgctgccagggggagc

SEQ ID NO: 12786 - DNA, 1066 bp, Homo sapiens
gagttcctcaatcgctggctctcaggagctgtttggaaaattcgttgccatgcatgagtcgggggattggttttttttccactggaaattgttaatggggactgcattagcggccccttatcgctttgcctgatagagagacagcaggttcgcccaaacaattctggaaccctgatcactgccaattaggggagtattgtctggctgacataatcaaatggtttcacgaaggcctctctcgacaccaggcagagaacttactcatgggcaaggaggttggcttcttcatcatccgggccagccagagctccccaggggacttctccatctctgtcagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggaga

SEQ ID NO: 12787 - DNA, 1304 bp, Homo sapiens
gatgatgaaaggagaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggctctgctgccctccccctggcagagaggcacaatgaccacattatttctcttccagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagct

SEQ ID NO: 12788 - DNA, 568 bp, Homo sapiens
aaaagtcataaaagcattctatgctggaccggttcgtgttaagtctgagttcctcaatcgctggctctcaggagctgtttggaaaattcgttgccatgcatgagtcgggggattggttttttttccactggaaattgttaatggggactgcattagcggccccttatcgctttgcctgatagagagacagcaggttcgcccaaacaattctggaaccctgatcactgccaattaggggagtattgtctggctgacataatcaacttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaaatggtttcacgaaggcctctctcgacaccaggcagagaacttactcatgggcaaggaggttggcttcttcatcatccgggccagccagagctccccaggggacttctccatctctgtcagg

SEQ ID NO: 12789 - DNA, 1279 bp, Homo sapiens
tttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggccttcagctgtcactgcttcctccttgtcttgggaattttcacggagaacagctaagca

SEQ ID NO: 12790 - DNA, 1100 bp, Homo sapiens
acagactgcagggctgactagggttagtttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagcttcacgttacagcatggaagctgttgccaagtttgatttcactgcttcaggtgaggatgaactgagctttcacactggagatgttttgaagattttaagtaaccaagaggagtggtttaaggcggagcttgggagccaggaaggatatgtgcccaagaatttcatagacatccagtttcccaagcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggaggtcctggatagctccaacccatcctggtggaccggccgcctgcacaacaagctgggcctcttccctgccaactacgtggcacccatgacccgataa

SEQ ID NO: 12791 - DNA, 1393 bp, Homo sapiens
agactgcagggctgactagggttagtttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaagatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcttgcagagcagctctcctcctgttctccaaggggtgggcactgttgcattaggaattaaggtgcagcccagtgctgcgggcagccaagcgagtctgagcggggatgtgaaggcaggacggggttggagagaccctgcctgtgcaaggctggcctcctagtcaacacctagctgagacattcatctctgttcaaattaatattccttgggtctttcaaatgaatgtttcaatgtgaggagcgaagtactgggaaatcgagggattttccac

SEQ ID NO: 12792 - DNA, 1425 bp, Homo sapiens
attctatgctggaccggttcgtgttaagtctgagttcctcaatcgctggctctcaggagctgtttggaaaattcgttgccatgcatgagtcgggggattggttttttttccactggaaattgttaatggggactgcattagcggccccttatcgctttgcctgatagagagacagcaggttcgcccaaacaattctggaaccctgatcactgccaattaggggagtattgtctggctgacataatcaacttcacgttacagcatggaagctgttgccaagtttgatttcactgcttcaggtgaggatgaactgagctttcacactggagatgttttgaagatggtttcacgaaggcctctctcgacaccaggcagagaacttactcatgggcaaggaggttggcttcttcatcatccgggccagccagagctccccaggggacttctccatctctgtcaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggaacgccgaggaggcagccttgacataaatgatgggcattgtggcaccggcttgggcagtgaaatgaatgcggccctcatgcatcggagacacacagacccagtgcagctccaggcggcagggcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggagg

SEQ ID NO: 12793 - DNA, 4170 bp, Homo sapiens
aagtctccgggctcctttcacatctgcaggagcagccagcctgggaccgcgcggcgcggggcgcgctctcgcctctcctgcaccctcagccggcgcgcttctcttatgggcgtctgctgcagtctggctgcggtcgaactgaaagcggcggcgggagaccaaacttagaccccgctgtggactagagaactcagagaaggcagagggagagggagagagagagagagaagggacccgaggaggaggcttccatcacgtcattgcaggatgttctggaagctttccctgtccttgttcctggtggcggtgctggtgaaggtggcggaagcccggaagaaccggccggcgggcgccatcccctcgccttacaaggacggcagcagcaacaactcggagagatggcagcaccagatcaaggaggtgctggcctccagccaggaggccctggtggtcaccgagcgcaagtacctcaagagtgactggtgcaagacgcagccgctgcggcagacggtgagcgaggagggctgccggagccgcaccatcctcaaccgcttctgctacggccagtgcaactccttctacatcccgcggcacgtgaagaaggaggaggagtccttccagtcctgcgccttctgcaagccccagcgcgtcacctccgtcctcgtggagctcgagtgccccggcctggacccacccttccgactcaagaaaatccagaaggtgaagcagtgccggtgcatgtccgtgaacctgagcgactcggacaagcagtgagcgccgggccggacgcagctcagccccgcgcgcgcccggccgctgggtggcgccgccgccgcctctgtccctgccctccgagcccactgtcacgctgcctggtgttccccctcagcagcaagcacttctcttagggctgacggtgtccttgtcacagacgtggatcgcaagtggagcttttgctgatgtgttcctgaccgaccccgggtcccacctgtgccccctaaaccaggcggtggatcaggcccgaaggaaaatgctggaaaaccaccaccgccacccagcagtcagagaggacctttcgaggtgatgcactgtaaatccggcattgatgtttccaccatgtggaaaagcaaggatttccctggccccgccctgcactccagctcgcccctttcccgcgcgaagtgaaggatgcgtcacttttctgagcggcccctcagacctctcctgctggtccctggacctctggctgggagcgctcattcttgtgactggcaggctgccctcggtcgctgctgtgatgaggatatgtgcaacctccataaatatgtcggtggacggggcgtctcctaataaacctgataccaagaagacaacttgagccacttggatcccgaagtgggcttcccgggaaacctcgagcagagcaggctacacaatcccccatcctcaagtccccaccgcctcttcttcctcactgtccccgccccctatttgtggactaaagatgaactctggtgtgcatgctattattgctgcaattagaatattatcacacacaaaggtctctatattaacgctggttttataagtgaccgtatattgtaaagagctgttaaaaagtattatagacctattcatgtattatttcacatgttttgactctggcttgcagcaccattcggagtaaggatgacagcaggcccagaaggtgtcttactcagaaaaaaaaatgcctggtcagcaattcactgtcatgcacctatttttagattgggcagggagatgggaggagtcgtgatttttactttgaatactatttcactgacgttactaagcattgcagcacaatgtagaaattggcttgggatggataggtatagggaagggcattcgttgggaaattgatgaccggaaactagaaagcccctataatgtggaatatgcatatgtggggtgaaaccgtatactactttcactgccatgacactaggcaaaaaatatttcctgttaaaagaaagagaaaaagagagggatattgaaaaatataaggagttgagtcgctttgtggtatagaagggagtaaggaataaaagatatagaatagtaatctagttgaactgttctgcacaaaacatgcttccttttcaaagaatagacttcaaaagggacgaacaaacattaggtcaccttttgtgtttataatgaattgttgacgtttccatgctgtggtctcttgatatacggaagtagacgtaacttattttccagcgaaattatatacttcttctgggctcctttgctcagttgccccaggaaggcttccctgtgagtaatgcttatggaatctgacaaatgtgaatgagctgccattggtgggaatcagtaaactttgaaaacctttcactgatgattccctggtaagtgctcctgtgaggggccacttccctagtatgtgagagagaccctctgcaagccgctgtggggacttagcttcctgatactaggtagtgatggtggatctagagacattcacttgaagagcaaggattggggtggggtgggttggtgaatctatctcaggccactgcactgcaaggtgcatttctgtcatttctgcaacaccatgagacctgagcaagaatgtgctgtggcagagggggtcttggtttcataaatgggtatatacagcctgaactcaggaggcagaaatcaaaagaaatccttgagggctggaacctgaggatagagcgaaaatggagagaagggtgttcaaggtcaggagtgatttttgcatttggtggaaaacctcaagtcagactcagtggcagaacatgcagcagaaaagctgtgaaggaaggaaatttacgtgattgtaatggaggctaggggtggattgggaggtgagtggaggagagtctctgaccagctgcagagccaacccctatcattttattaacatggaacccacacagataggggagggattaagctaagaacttacagaatgcaaacacgagcacactctcttcgaacccaattgtgggtgtagcaatgaaagcaatatgatatgctgcagtgtgaagctccttctggggttatcgtatgtacaaagtttaccttataatggctcaaattgtatttaatttttttgttttgtttataaatgaagaaaagctataagtataatgtaattattttataggtatactattaaattatagaacaaataaagataatctaggattatatgtgatcccggtgtgacgtgccataaaagtggaatttttgacttgttgcagtgagctgtgaagcagcactatgcgttcagagagtttttgttcaaccatggtgagttcaacctctagcttatgtcacatgatctcctttggggtctggaatcttctaagagaaatagaatcaggcatccaaggagcagaagtgatggaggtggccctcaatcctggtctttggaagcttccaagcctcttccacatcccctgccagctgaagacagagtattctcactgtgctggctgaaggagaaacactaaacaaggaaaccttgagaaactgcagcaatggaagtccactgttagtctctccgttagcaccagggacacacttgttctgagttttgttcattttcacatttactcctcatgagttccaacatttcttaatttaaatatttcttagtttatagcatctccatttttctattaattgacttaatctgccatttaagaaaactccgtaatcaataaaaaataaaatccacaatcaaactgcacatggttgatccactgtgtaggcttcaaaggaattaaactcaacttcctaggaaataattcatcttagtttattaaatgggacagaatatttcactgctaacgtattctaactcacttgtttttgaaattggccagatgatttttaagttataaagtcaatgaaaatgacttttgctattgtgtgaacaacttagaatgtatatattcccagaaggcttatttaatgattgacctatcaccactgattattaatgtctgcatgaatgataacaataagaccaagtcatcaataatgcaatgaaaattttttaagtgaaagcaagtttattaagaaagtaaaggaataaagaatgcctacttcataggcagagcagcctaa

SEQ ID NO: 12794 - DNA, 6666 bp, Homo sapiens
agtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctactctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcagtagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagctaatgagttttatttgcacatctctggaaaaagaatgcaagcaaagcattaaaatgctatatgatggatgggtaaggttgaaaggatatatcttcttggcacgctacaggctgagttttctgtacaaaatgtggccattattgggaaatcattttatgtatttgaatgctcccttttgtttttgttcatgatctaggctagtacgtaagtgattgctaaggtggatgtagttatgggaaaggaagagaagcacataatacagtaaaagtaatcttatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggcatatggtcagggtgctcatatcctgctttagcctagctgctgcttacggagtgcaagggagaactctgagaagcagtatgtaaataccagggagctgattgctgaatattgtggtctcatctgaatattgtggtctcatctaaatattgacaccaggcaatgaagcagaaatagagtatgtgtccctttatgcgtgggtaacttaagcttctgtcatgtgggaagggggaccgaatcttccctgggaggaaggctccaaattctcactacttctgtgttacttgaagggggaagcataaggaacccagtttgaaggcaacattgtgtgccatgaatctgcttattaatcaacatgccttgttaatgtcctctgccctgaacagcccttactcagttctcatttggaaagttattttttggggttacatcctgtttgtttcagaatttaaaaccctccatggtgggtcacttgaggtcaggagttcaagattagcctggccaacttagtgaaactccggctctactgaaaatgcaaaaattagccaggtgtggcacacgcctgtaatcccagttacttgggaggccaaggcaggagaatcgcttgaacctgggaggcagaggttgtagcgagccaagatcacaccattgcactccagcctgggcaacagagtgagactctgtcaaaatcaaaaaaaccaaaatacaaaaaactccattgttctgagagtttcccctaaattatcggaagacactcacattgaattggtaggacctatagtatagaggagaatggtatgtatgtcagcagtagagttccaatccaaattgcgctatcgcattagaaatacattaccctcccactccccaagttcagcaaattagaagagaatctgaagtttgtaggaagggaataaagctgctataaacatttatgtgcaggtttttgtgtagactcgttttcagctcctttgggtaaataccaaggaaccaggttgctggattgtaagttaagagtatgtttagttttggaagaaactgccaaactgttccaacatgactattttgaattcccattgacaatgaataagagttcctgtagctcctcaccctcattagtatttggtgatgtcactcttgcattttagctaatgggtgaatagtggtctcatcgttttaattcccaatcccatagtgatgtggagcaccttttcatatacttaatctgccatccttatatcatcattggtgaggtgtctggattttctgtccagaattttagttctagtggttttcttatttttagaaaggaagtataggaaggaaggtttaatctgtcttaagcctgattatatgaaaatcaagaataggctaggtgtggtggctgacatctgtaatccccgcactttgtgaggctgaagtgggaggactgcttgagcctgggaagtcaagcctgcagtgagccatgactgttgctgcactccagcctgagtgacagagtgagaccctgtctcagaaaaaaaaaaagcaggctcattttaaagttgtttatattttattttttgaaggaaataaacttgaagagatacaaacggtagtgaagattctccttcccctcctgtaattcagctgtttagtttctattctcgcacagccctgttatcagtttctagtgtaagcttgcagtgacttttactttatttataagcaagtgttagtgggtgttgtcatttcttttaaaaatataaattatactgtacatgctattttgtattttggcttttctcccacctaaacaccctaaagatcattttctgtcagtatataaaatcttggtgatgccaatacccatcccttagattgtacaagcagcattttgccatgctttatcccatagcctgcctcctgcagtctcatctttttttctatatgcatgtccaagtaagttgtagacatttttcacttttaatcctttcagcatacatgtcatgggaatttgtttttgtttttgttttttgtgtttgagacagtcgctctgtcacccaggctggagttatagtgacgtgatcccagctcattacagcctccacctcccagtttcaagcaattctcatgcctcagattcccgagtagctgggattacagatgtgcaccaccacgcctgactaatttttgtatttttagtagagatggggtttcatcatgttggccaggctggtctggaactcctggcctccagtcatttgcctgcctcggcctcccaaagtgctgggattacaggcatcagccaccacacccagccgtcattggagtttttttgagggagatttgcagtaaggtgaataaatgttaagtgtatcatttgatgaggttttttctttttttttttttttttttgagatggagtcttgtatcgcccaggctagagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgtacaac

SEQ ID NO: 12795 - DNA, 6462 bp, Homo sapiens
gcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgagtctctggtcggttgggcagtgagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcagtagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagctaatgagttttatttgcacatctctggaaaaagaatgcaagcaaagcattaaaatgctatatgatggatgggtaaggttgaaaggatatatcttcttggcacgctacaggctgagttttctgtacaaaatgtggccattattgggaaatcattttatgtatttgaatgctcccttttgtttttgttcatgatctaggctagtacgtaagtgattgctaaggtggatgtagttatgggaaaggaagagaagcacataatacagtaaaagtaatcttatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggcatatggtcagggtgctcatatcctgctttagcctagctgctgcttacggagtgcaagggagaactctgagaagcagtatgtaaataccagggagctgattgctgaatattgtggtctcatctgaatattgtggtctcatctaaatattgacaccaggcaatgaagcagaaatagagtatgtgtccctttatgcgtgggtaacttaagcttctgtcatgtgggaagggggaccgaatcttccctgggaggaaggctccaaattctcactacttctgtgttacttgaagggggaagcataaggaacccagtttgaaggcaacattgtgtgccatgaatctgcttattaatcaacatgccttgttaatgtcctctgccctgaacagcccttactcagttctcatttggaaagttattttttggggttacatcctgtttgtttcagaatttaaaaccctccatggtgggtcacttgaggtcaggagttcaagattagcctggccaacttagtgaaactccggctctactgaaaatgcaaaaattagccaggtgtggcacacgcctgtaatcccagttacttgggaggccaaggcaggagaatcgcttgaacctgggaggcagaggttgtagcgagccaagatcacaccattgcactccagcctgggcaacagagtgagactctgtcaaaatcaaaaaaaccaaaatacaaaaaactccattgttctgagagtttcccctaaattatcggaagacactcacattgaattggtaggacctatagtatagaggagaatggtatgtatgtcagcagtagagttccaatccaaattgcgctatcgcattagaaatacattaccctcccactccccaagttcagcaaattagaagagaatctgaagtttgtaggaagggaataaagctgctataaacatttatgtgcaggtttttgtgtagactcgttttcagctcctttgggtaaataccaaggaaccaggttgctggattgtaagttaagagtatgtttagttttggaagaaactgccaaactgttccaacatgactattttgaattcccattgacaatgaataagagttcctgtagctcctcaccctcattagtatttggtgatgtcactcttgcattttagctaatgggtgaatagtggtctcatcgttttaattcccaatcccatagtgatgtggagcaccttttcatatacttaatctgccatccttatatcatcattggtgaggtgtctggattttctgtccagaattttagttctagtggttttcttatttttagaaaggaagtataggaaggaaggtttaatctgtcttaagcctgattatatgaaaatcaagaataggctaggtgtggtggctgacatctgtaatccccgcactttgtgaggctgaagtgggaggactgcttgagcctgggaagtcaagcctgcagtgagccatgactgttgctgcactccagcctgagtgacagagtgagaccctgtctcagaaaaaaaaaaagcaggctcattttaaagttgtttatattttattttttgaaggaaataaacttgaagagatacaaacggtagtgaagattctccttcccctcctgtaattcagctgtttagtttctattctcgcacagccctgttatcagtttctagtgtaagcttgcagtgacttttactttatttataagcaagtgttagtgggtgttgtcatttcttttaaaaatataaattatactgtacatgctattttgtattttggcttttctcccacctaaacaccctaaagatcattttctgtcagtatataaaatcttggtgatgccaatacccatcccttagattgtacaagcagcattttgccatgctttatcccatagcctgcctcctgcagtctcatctttttttctatatgcatgtccaagtaagttgtagacatttttcacttttaatcctttcagcatacatgtcatgggaatttgtttttgtttttgttttttgtgtttgagacagtcgctctgtcacccaggctggagttatagtgacgtgatcccagctcattacagcctccacctcccagtttcaagcaattctcatgcctcagattcccgagtagctgggattacagatgtgcaccaccacgcctgactaatttttgtatttttagtagagatggggtttcatcatgttggccaggctggtctggaactcctggcctccagtcatttgcctgcctcggcctcccaaagtgctgggattacaggcatcagccaccacacccagccgtcattggagtttttttgagggagatttgcagtaaggtgaataaatgttaagtgtatcatttgatgaggttttttctttttttttttttttttttgagatggagtcttgtatcgcccaggctagagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgt

SEQ ID NO: 12796 - DNA, 2491 bp, Homo sapiens
gcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgagtctctggtcggttgggcagtgagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatc

SEQ ID NO: 12797 - DNA, 1794 bp, Homo sapiens
gcacacagttgcgtgggctggcttgtagggaaggagcctgtccccatcgcgccgttccctctcctgtccccagggaaagacgagctgtcccggtttactgaaggtcacctctgcaactccactcatacagaaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaa

SEQ ID NO: 12798 - DNA, 1765 bp, Homo sapiens
acccgcccccgtccaccctgtgctcctattgggccctggaacaagggaagctctcccaggcgtcgggtcttctgcttgttttgttctcgcctcgagtctctggtcggttgggcagtgtaagtgtggctggggtgaatgttgaggccttgttccccgcctggcccatggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaata

SEQ ID NO: 12799 - DNA, 2656 bp, Homo sapiens
acttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctg

SEQ ID NO: 12800 - DNA, 1738 bp, Homo sapiens
attgggccctggaacaagggaagctctcccaggcgtcgggtcttctgcttgttttgttctcgcctcgagtctctggtcggttgggcagtgtaagtgtggctggggtgaatgttgaggccttgttccccgcctggcccatggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacggtttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaata

SEQ ID NO: 12801 - DNA, 2361 bp, Homo sapiens
gtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctactaa

SEQ ID NO: 12802 - DNA, 1313 bp, Homo sapiens
gctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagataaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttag

SEQ ID NO: 12803 - DNA, 1367 bp, Homo sapiens
gctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagactgaagtggaaaccagagagataggagtgggctgtgatcttctacccaggcaaagtagaaaattcgaaaaggtcctcaacgagtttgtacagctgctcccactccctcatcacctcttgtgggcctttggaaatgtatgttggaggagacattttggattgttgcaatga

SEQ ID NO: 12804 - DNA, 2181 bp, Homo sapiens
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttcta

SEQ ID NO: 12805 - DNA, 1516 bp, Homo sapiens
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 12806 - DNA, 1846 bp, Homo sapiens
gcggtgcagctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatc

SEQ ID NO: 12807 - DNA, 1427 bp, Homo sapiens
gctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttag

SEQ ID NO: 12808 - DNA, 2601 bp, Homo sapiens
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccaggtgcccatcccaacgttactattatatcataatttgattctccctccccccatccccccgccaactctgtaaaccccaagtataacacaggacgttgctatttgttgactgacacatagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacga

SEQ ID NO: 12809 - DNA, 2300 bp, Homo sapiens
gctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctact

SEQ ID NO: 12810 - DNA, 2384 bp, Homo sapiens
gctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaactagtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctact

SEQ ID NO: 12811 - DNA, 4149 bp, Homo sapiens
acggaagcgccgttgtcggcaggcagctttagttaggatgtcgtgatgggaccgagctcagcgtaaccctctggccgacgtgggccgagggggccggcccgggctgctgtggcccagacgagcggagagtgcggagcggcttctgggccagcgctaacgagccctggcagtgcgcacctctggtgccagtgtcgccccgcctccggggtagaatccgccccagccctccgggcctgggaccgggcggccgctttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctccatggagaagtttgggatgaatttcgggggcggcccgagcaagaaggacttgctggagactatagagacccagaagaagcagcttctccagtaccaggcacggctcaaggatgtggtccgtgcctataaaagcctgctgaaggagaaagaggcattagaggccagcatcaaggtgctgtcggtatcccacgaggcagatgtgggcctcgcaggtgtccagcttccaggcctcacctttcctgactctgtggatgaccggtgctccactcacagcgaggatagcactgggaccgccactagcttggatactgcggccagtctcaccagcaccaagggtgagtttggggtagaagatgacagaccggcccgtggaccaccacctccaaagtccgaagaggccagttggtccgagagtggcgttagcagtagcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgccttgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagatccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttgacctgtgtggt

SEQ ID NO: 12812 - DNA, 6512 bp, Homo sapiens
gcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaagcaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattatgctaagttaaaatacagtttagttatttgctttaaaataaactcttctttttttctttaaagtatactatctcaaaactcattatgttgtcagagccctagagctggctagtgtaacactgactatgagtaggtgggcccacacttgagttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctc

SEQ ID NO: 12813 - DNA, 2356 bp, Homo sapiens
tgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaacaataaactcagttcagaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctaaaaaatgatcctctgtcttcagtaa

SEQ ID NO: 12814 - DNA, 2057 bp, Homo sapiens
ccttcgggaaagggtggcctcgggccccctactctacagagtctcctcccacggctgcccagttccctggccgactatcttgcctccaccacatcaccatcagtaccgggcggctgcagggcagagctgtccagggacctcctcacagcctccagagtcaagaaatgcctcctcagggaagccctctaccgcatccctgacctgtgagtcacggagctcccgggcaccatgctggccacaaatgcctaaggagccccccggaaccagctgtgggtcccgcaggcactcgcaggctagcggacacctttggaggactgagagacctgtcctgcaatccaatgttcctcactctcacaagattttacagacgtggaaaccgaggcccgaggccccaaggggtaatcggcccgccttcccatgccaataaccggcagtggcgggacccacacctactccgtgacctgcaggcccaggggtcgagccccaggtagaacgtctagacggactccgcccttagcgccgtacggggaaccttctcccggacgcagacacggaagcggaagtgctgccgagctgtagctatggagacgtggggggcgggccgcccggagagcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattc

SEQ ID NO: 12815 - DNA, 3255 bp, Homo sapiens
gcagaaagctggcgggggggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccagggtaaggggaaaggaagaacctacagctccagcttctctcaacccaaaaatctgagaacccctccccttttctcctcacctaaacccatctcctactttgggcgcagcacacatattttcttgtcaacttttccccaagcccaccaacttggattcagattgcgacatgcaggacaggccagtcattctctctctctgactttctgtttaatcatctgtgggctaattcccccttctctggtgccataaattatgtggctcatagtaggtgcaccatccaaggagaaggtccctttttccaacttgtaatgatcactaattattattgccggctgtcatgtcagcctccttaccagccactttcctttggaaataacttttttattgttccacaaatagtatgtgctcattgtagtacattttttaaaaaccacaaatgagcaaagatttttttaaaaccttaaatgtctggccgggtgtggtggctcatccctataatcctacactttgggaggccaaggtgggcggatcacttgagctcaggagtttaagaccagcctgggaaatgtggtaaaactccgactctatttaaaaaaaaaacaaaaacaaaaaaaccttaaatgtcaaaaaaaaataatattttcaccatccagacgtcaccattataaattcttagttcagggctgggcgcggtggctcatgcctgtaaccctagcactttgggaggctgaggcgggcagatcacttgaggttaggagtttgagaactggcctggccaacatagcaaaacctcatctctactaaaatacaaaaattagccgggcgtggtggtgcgtgcctgtagtcccagctactcgaaaggttgaggcaagagaatcgcttgaacctgggaggtggaggttgcaatgagccgagatcacaccactgcactccagcctgggcaacagtgaaactccatctcaaaaaataaataaataaaataaattcttagttcatacccttccagaattctctctctttttaaaacctagatgagattaacctgttttttattcaactgttgtctctaccttcccaatttgatcaattttcatgtcattggctgggtgcggtggctcctgcctataatcccagtactttgggaggccgaggcgggcagatcacttgaggtcaggagttcaagaccagcctggccaacatggtgaaaccccatctctactaaaaatacaaaaattagctgggcgtagtggcgcgtgcctgtaattccatctactcgggaggctgaggcaggagaatcgcttgatcctgggagttggaggttgcagtgagccaagatcttgccattgcactccagcctgggcaacaagagtgaaattctgtctcaaaaaaaaaaaaaaaa

SEQ ID NO: 12816 - DNA, 2909 bp, Homo sapiens
ggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 12817 - DNA, 3032 bp, Homo sapiens
gcgcagaaagctggcgggggggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 12818 - DNA, 2882 bp, Homo sapiens
gggggggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 12819 - DNA, 2939 bp, Homo sapiens
gcgcagaaagctggcgggggggtggggggaggaacatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaagagtcctggcccttgtctgccactgcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccac

SEQ ID NO: 12820 - DNA, 1972 bp, Homo sapiens
atattaagtaaactttagtgaggaacagcagtggaaaataatctatataccttggctcttttgcagtttgacaaagttaatgattaaaatctcctagattttccactacagtatccccagggtgtctatttaccttgattgatattattttatctcttttgggccaaagataacagccccttgcttctgtgtttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 12821 - DNA, 562 bp, Homo sapiens
atcaaaattcgtagaaaataatctgagtgtgtctttttgaatgaactaatcagaagatgacgaaatacagttgaataaaagggatacagaagagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgt

SEQ ID NO: 12822 - DNA, 1777 bp, Homo sapiens
actgttttttcaaagagattgcttactccaccaggagaatgatatctacctattctaccactggtgatgatctggactagtccaactggtaggaaatgctgtggtcttggagtgaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccat

SEQ ID NO: 12823 - DNA, 743 bp, Homo sapiens
ctgtgaggaccccgcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaaga

SEQ ID NO: 12824 - DNA, 2826 bp, Homo sapiens
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatg

SEQ ID NO: 12825 - DNA, 2170 bp, Homo sapiens
gagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggttctctccaacatgggtgtctgggttttgactgcctaagagaaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaa

SEQ ID NO: 12826 - DNA, 2014 bp, Homo sapiens
cattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaatttt

SEQ ID NO: 12827 - DNA, 2286 bp, Homo sapiens
ttttacttccgctcggtctatgaggactgatgaaatgtaggaaatctgtttctggcagggagaaaaaatcgttttcccaaacagcactaaaaggagccatcagagaagtatgaagaggggtagtgcggctgtagctgctgccgctgccgccaggctggtggggtgcggggagcggctgctgcaggacctgtgcctggagggggccggccccgagaagctgcaggagcccagcccggagcccaagcgcctctgagagccgccagcagcccagctcgggacgcgggggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtctctaaatcaatgcctcattctgaaatcaagttaattttcaaatggcaa

SEQ ID NO: 12828 - DNA, 736 bp, Homo sapiens
ccgtgcgaatggggccatgccgaccaaagcgccgatggatgtggcgcaggtagcgcgcccactgcaaggcccggcgcacggtggcggggtcccaggtgctgacgtaggtagtgcttgagaccgccagaagctcggaaaagcgatccaggtgctgcagaagggattccatgaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccc

SEQ ID NO: 12829 - DNA, 712 bp, Homo sapiens
cattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgca

SEQ ID NO: 12830 - DNA, 547 bp, Homo sapiens
gttggacaggctctttctctaagagtgggtattcactgcagggggtgactttctgattctctggaaacaaccatgtgttccttatccctattgcggaacaccccggacaaccgcagcacgtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttg

SEQ ID NO: 12831 - DNA, 579 bp, Homo sapiens
taatagggtgtaggtaaagttactgaacagccacatctcactttcaggaaagtagtggaagagattgtgtcttgagaagacaggcattttagaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggatt

SEQ ID NO: 12832 - DNA, 2530 bp, Homo sapiens
agggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccaggtgagcgcggagacccccagcactccctgcctgtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 12833 - DNA, 2237 bp, Homo sapiens
gccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggtgagatgcaggaggacgaggagtgaggggtccagagggtgggggggcgtcagccctggcctgcatgatgggttgcctgtgcgccagagtgactcacaccctgggaaaagttcccgtgggtgggggcgggcctggcttcccatctccatggcaacccaaccaaaccaacaacacagctggggcgggccctgtggctgggcggcagccagtccagctcttgcttcctctggcccgtcctgggaaggggggtgtctagagcccaggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagc

SEQ ID NO: 12834 - DNA, 2308 bp, Homo sapiens
gacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctcc

SEQ ID NO: 12835 - DNA, 2482 bp, Homo sapiens
ggacgcatagagctgcggctcgggcggcgcctccctgcggcggcccggcccggctccggcccccgctggggcaatgctccccggggccgcgggatgagccagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 12836 - DNA, 2924 bp, Homo sapiens
cgcggcggtgccgtttatctggccaggggaggtccacccgggaggaggtgactttgcagcctccagccgctatcgcttcctgccttcatcttgggaacaggccgtgctgtgcgccagcccggggagcccaccgtctggggaggggggcgattaaaaggtcccaacctcctccccaggagaccaaagaggttggacggggccccgggtactaggctgggtgggggttgggcgcctgggccggtcgcagttgtctgggggccctggggctctctgcgtcgagagcgctcgaagacccgggattcctggcccgatcgcgggcggggggagaccccagctccaccccagctcccgccggctcggggaaggggcggcccctttaagagcgcgcggccccgcccgccccctccgggcaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 12837 - DNA, 2481 bp, Homo sapiens
atagagctgcggctcgggcggcgcctccctgcggcggcccggcccggctccggcccccgctggggcaatgctccccggggccgcgggatgagccaggtgagcgcggagacccccagcactccctgcctgtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 12838 - DNA, 745 bp, Homo sapiens
cccgggaggaggtgactttgcagcctccagccgctatcgcttcctgccttcatcttgggaacaggccgtgctgtgcgccagcccggggagcccaccgtctggggaggggggcgattaaaaggtcccaacctcctccccaggagaccaaagaggatccgaattccagggaggcggggcggagacggcggcgaggaggaggccgcggcgcgggacgcatagagctgcggctcgggcggcgcctccctgcggcggcccggcccggctccggcccccgctggggcaatgctccccggggccgcgggatgagccagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgt

SEQ ID NO: 12839 - DNA, 569 bp, Homo sapiens
gctatcgcttcctgccttcatcttgggaacaggccgtgctgtgcgccagcccggggagcccaccgtctggggaggggggcgattaaaaggtcccaacctcctccccaggagaccaaagagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtgg

SEQ ID NO: 12840 - DNA, 3381 bp, Homo sapiens
atagagctgcggctcgggcggcgcctccctgcggcggcccggcccggctccggcccccgctggggcaatgctccccggggccgcgggatgagccaggtgagcgcggagacccccagcactccctgcctggtgcgcatggacgggggtggggaggcggggcgggaagcggcgtcctcggcctctgttccccggggctgtgtgaccttgggcggccccgcaccctctctgggcccagagccccagcaccggcagggcctgcggaggccgctctgagtcctggccccgcaggcaccggcctggagcgctggggaggcttcttggaggaggcggggcctggccctggccccggatcgccgagaccggccacgctgcgccgcctggacgccgggctcctccacccacagctctgcgaccttcacgagctcgaccctttctgcgcctcagtttcctcatctataaaatggagataatgcctccgcgcgctgagcccgagcgcggtcgtgctgttacactattgctgctgctatgtcgttaatgacggcacagcccttatggaaggggggccaaggaaggcacggggaccttcccgcaggacatggggtgggcaccagccctaagccatgcacataacccactctgaggtcaggacctgggttcctttcgtgtccactgggggccttagccgttgtcttcacttctctaggtcccagcccttcacaatgggcgcgcctccctgcctgagagggaggccccagccaagccccagtttccaccgcaaaaagccacacagcaaacacttaatggaccctaaatttataaaaattatcccatagagtcctatgaggcagggaatgttactgtacccatttcgcagatgaggaaacttggggcaccgacatttcccagagccaacatgtaaaccaggcatttggcctgagtgacagactggtgcaggtggccagcagcttaatttgtactgagcgcttactgggtccccacagcgatcctgaactgtgttcctgcccacagtgactcggccggtccgggcatggcagacccagtggcgggcatcgcgggctcggcggccaagagcgtgcggccatttcgctccagtgaggcctacgtggaggccatgaaggaggacctggccgagtggctcaatgccttgtacggcctgggtctcccgggtggtggcgatggcttcctgacagggctggccacgggcacgaccctgtgccaacatgccaacgccgtgaccgaggctgcccgtgcattggcagccgcccgcccggcccgaggtgtggccttccaggcgcacagtgtagtgcctggctccttcatggcgcgcgacaacgtggccaccttcatcggctggtgccgcgtggagctgggtgtgccggaggtgctcatgtttgagactgaggacctggtgctgcgcaagaacgagaagagcgtggtgctgtgcctgctggaggtggcgcggcgtggggcacgcctgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagggagattctgggccgctgcacctgccctgaccagtttcccatgatcaaggtctcagaggggaagtaccgtgtgggggactcgagcctgctcatctttgtgcgggtgctgaggagccacgtgatggtgcgagtgggtggtggctgggacacgctggagcattacctggacaagcacgacccgtgccgctgctcctccactgctcatcgcccaccccagccgagggtctgcaccttttctccacagagggtgtcgcccaccaccagtccccgccctgctagcccagtccctgggagtgagcgccggggctcccggcctgagatgactcccgttagcttacgaagcacaaaggaggggcccgagaccccacccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctctgttgtacattccggttgggggatgagcgttgctatttaattactaatattattgaatgccttagaggaggccgggcgagcccggtgttctgaagacctgtggcccagcagagcctctgacagtaaagttttgctccagc

SEQ ID NO: 12841 - DNA, 2490 bp, Homo sapiens
gcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaa

SEQ ID NO: 12842 - DNA, 2188 bp, Homo sapiens
atgtgcatgtgccaggcctcgcctccccccgccgccctagcgggatgtctgctgtcaagctgtgttcagccagccagagagcatggaggggctttctccaaagcagagtggctttccaactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgt

SEQ ID NO: 12843 - DNA, 2632 bp, Homo sapiens
ccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttgccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggattatttttacccaagatacttagactgcatcaacaagtatgggtctccgtacaccaaaaactcaggcttcgccacctgcgtgcaaaacctgcctgaccagtgcacgcccaacccctgcgataggaaggggacccaagcctgccaggacctcatgggcaacttcttctgcctgtgtaaagctggctgggggggccggctctgcgacaaagatgtcaacgaatgcagccaggagaacgggggctgcctccagatctgccacaacaagccgggtagcttccactgttcctgccacagcggcttcgagctctcctctgatggcaggacctgccaagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgt

SEQ ID NO: 12844 - DNA, 2505 bp, Homo sapiens
cacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgt

SEQ ID NO: 12845 - DNA, 2170 bp, Homo sapiens
ttgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgagatgtggacgagtgtctgcagggccgctgtgagcaggtctgcgtgaactccccagggagctacacctgccactgtgacgggcgtgggggcctcaagctgtcccaggacatggacacctgtgaggacatcttgccgtgcgtgcccttcagcgtggccaagagtgtgaagtccttgtacctgggccggatgttcagtgggacccccgtgatccgactgcgcttcaagaggctgcagcccaccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacaatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacatgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgt

SEQ ID NO: 12846 - DNA, 8211 bp, Homo sapiens
gtcccccgcctgcctgaggacccccgcgcaccccagagacggcgcgcgcccagagcgcgggagcccggagcgccgggcgcctgggaccccgcggagccgctgcccagcccgtggggctcggcgggaatgcaggctgcgctgtgaacccgggcgccaaggccatgtccggcgctcgctgccggaccctgtaccccttctccggggagcggcacggccaggggctgcgcttcgccgcgggcgagctgatcacgctgctgcaggtcccggacggcggctggtgggaaggcgagaaggaggacgggctccgtggctggttcccggcgagctacgtgcagttgctggagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 12847 - DNA, 8181 bp, Homo sapiens
agaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 12848 - DNA, 7773 bp, Homo sapiens
cccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 12849 - DNA, 8024 bp, Homo sapiens
atgcttttctttagagctcctattgcttctgggtttggggtgtgagaggatgcagagtgggagaccttaaaaccgtctgatctggctgctaaagcgagtgtctgacgaccacccattaacaccagcgagtagcgtttgctcacggctttaggataagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagtt

SEQ ID NO: 12850 - DNA, 1944 bp, Homo sapiens
tttcccggagaggctgccatgaagaggaagccggcggagtcttggtgctgagtctgagggcttcaggcaggacccaagactctcctctgaggtagcagcccccagagaaggttagctgttctctgatgaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgactt

SEQ ID NO: 12851 - DNA, 4277 bp, Homo sapiens
gtcccccgcctgcctgaggacccccgcgcaccccagagacggcgcgcgcccagagcgcgggagcccggagcgccgggcgcctgggaccccgcggagccgctgcccagcccgtggggctcggcgggaatgcaggctgcgctgtgaacccgggcgccaaggccatgtccggcgctcgctgccggaccctgtaccccttctccggggagcggcacggccaggggctgcgcttcgccgcgggcgagctgatcacgctgctgcaggtcccggacggcggctggtgggaaggcgagaaggaggacgggctccgtggctggttcccggcgagctacgtgcagttgctggagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacagagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgattt

SEQ ID NO: 12852 - DNA, 1010 bp, Homo sapiens
cacttctctcctggtgaacaagtggaaggaggatggctgggatgatgcagaagccgttttttcagggcaggaggggaagataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggt

SEQ ID NO: 12853 - DNA, 1799 bp, Homo sapiens
cctctctgctcccagaggagctgtcctctgtgcaggggctctgaatgctcaggtgcttctcactgctcatgctcacgcaaccccggaggtcacgtgtgtgctgcctctgacctcaggggtttatgggccgcagacttcccaatgtcacgctactgtaggaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctccaacagtgaatggataccacgcatcagggaccccagcgcaccctccagagactgcccacatgagtgtccgaaaatccaccggtgattcccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatca

SEQ ID NO: 12854 - DNA, 2417 bp, Homo sapiens
aattcgccttcagcccgagagctgggcgtgggaacagcgtggggtcagggagacccctgcttgccctggcccagaatatggtgacttaggattcagactgagcatccctgattccccagcgcctccaccctcagggaacctgaatggggggaaaaaatgtccaatatggagaacagctttgacgatgtttcttgcctctctccccagaacctgggatcctcatcgccaagcaaaaagcagagcaaggaaaacaccatcacaataaactgtgtgacgttccctcacccagacacgatgccggaacagcagctgctgaaaccaaccgagtggagctactgcgactacttctgggctgataagaaggacccccaaggcaacggcaccgtggctgggtttgaactactgctccagaaacagctgaagggcaaacaaatgcagaaggaaatgtcagaattcatccgggaaaggataaagattgaagaagactatgcgaagaacttagctaagctctctcagaactccttggcttcacaggaggaaggctccttgggagaggcgtgggcccaggtgaagaagagcctggcggacgaagcagaagttcacctcaagttctctgccaagcttcacagcgaggtggagaagcccctgatgaacttccgtgagaacttcaagaaagacatgaagaagtgcgaccaccacattgccgaccttcgcaagcagctcgccagccgctatgcctcggtggagaaggcccggaaagccctcacagagcggcagagagacctggagatgaagacccagcagctggagatcaagctgagcaacaagacagaggaggacatcaagaaggcgcggagaaagtccacacaggctggagacgacctcatgcgctgtgtggatctctacaaccaggcccagtccaaatggtttgaagagatggtgaccaccacattggagctagagcggctggaggtggagagggtagagatgatccggcagcacctgtgccagtacacgcagctgcggcatgaaacagacatgttcaaccaaagcacagtcgagcccgtggatcagctgcttcgaaaagtggacccggccaaagacagggagctgtgggtcagagagcacaagacgggcaacatccgccctgtggacatggagatctagatgggcctgtgcagcttcggggggtcctgctggggaggggggctgggctcccaccatggggcccatgccgagtggatgccccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcc

SEQ ID NO: 12855 - DNA, 3189 bp, Homo sapiens
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcagtgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctccagtagccctcagtgtcgaaggtgagcttgtaggtgcctgccttcatctggtccaggacagtgaccatctgggtctgtgtagctggggagaggatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgttttataa

SEQ ID NO: 12856 - DNA, 1669 bp, Homo sapiens
gacaccaccgggacctggctgcgccctcccgaccccggccgggcgtccggggctcctgcgcactcacttggcggccgcgcccgctggcgtcctcttgttctcttccaggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacactgggccagggccccgcgggactggtgggcaccccgacgtagctgcccccctggggggccacagcccagagaaccagcctaggaacactcgggatgacaccccttatcacaccaaggacagcaagttttttagattttatcatcagcaaatgaaagcttttcacatgtt

SEQ ID NO: 12857 - DNA, 1080 bp, Homo sapiens
ctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggtgctgtgcgtgggctgggctggggaggcacactctgcctgtcctagaatgtgggctgcagagtcctggggatccagaccccagctctccaccccaacacacccagtactttttataagattgtttgacaatgcccctctcatatccttaactgaaattcctaaataacgtaacctatctctacctattgttaaaagcagtcaggatattgccctcaccgtagtgcagagggggaagtaatgaagtgtgttctggtttgtaaaagctcagatggaaccgcagtgagggccgtgatgtggctggagtggataggtgtcatagtcactgcctgcgacaggtg

SEQ ID NO: 12858 - DNA, 1308 bp, Homo sapiens
gcttccgggggcgggcgccctggtcccggagtcgccgctgggcctgtccgctggcgtcatggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggagacctttttctgctgacaaccctgtgtggatggatgcatccatcaaaccaggctgctattcgctggatctctcagaacgcccactggagtccccaggccgctcccgttgcctcggcc

SEQ ID NO: 12859 - DNA, 1691 bp, Homo sapiens
tccgagaaagagacggagagagagggaagaaaaagacagatagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 12860 - DNA, 1901 bp, Homo sapiens
acagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacagaattaaaagggaacctggtctctgggttgttttcaacatctcaagtgtgaattttccctgtcaaaatcttcacaaggaaaatgagtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgatgacaaagtcctgctctgaattatgccaccccgcactccactttttaccttgcctgggaggcttgaggaaaaatcttcagagagcagttcgacctagtccttattcacttggcttcttgactttctggatttcaagggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaggtccaa

SEQ ID NO: 12861 - DNA, 2558 bp, Homo sapiens
acgcggggcgcgcggctccgtcggctaccgcgggcgggcgcaggcgacgggcacggcgggcgagcgggcggtatggcggcggcggggcccgcggcggggccgacggggcccgagcccatgccgagctacgcgcagctagtgcagcgcggctggggcagcgcgctggcggcggcgcggggctgcacggactgcggctgggggctggcgcgtcgcggcctggctgagcacgcgcacctggcgccgcccgagctgctgctgctggcgctcggcgcgctgggctggaccgccctgcgctccgcggccactgcgcgcctctttcggcccctggcgaagcggtgctgcctccagcccagagatgccgccaagatgcccgagagcgcttggaagtttctcttctacctgggcagctggagctacagtgcctacctgctgtttggcaccgactaccccttcttccatgacccaccatctgtcttctacgactggacgccgggcatggcagtgccacgggacattgcagccgcctacctgctccagggaagcttctatggccactccatctacgctacgctatacatggacacctggcgcaaggactcggtggtcatgctgctccaccacgtggtcactctcatcctcatcgtctcctcctacgccttccggtaccacaatgtgggcatccttgtgctcttcctgcacgatatcagtgacgtgcagcttgagttcaccaagctcaacatttacttcaagtcccgcggcggctcctaccatcggctgcatgccttggcagcagacttgggctgcctcagcttcggcttcagctggttctggttccgcctctactggttcccgctcaaggtcctgtatgccaccagtcactgcagtctgcgcacggtgcctgacatccccttctacttcttcttcaatgcgctcctgctgctgctcacccttatgaacctctactggttcctgtacatcgtggcgtttgcagccaaggtgttgacaggccaggtgcacgagctgaaggacctgcgggagtatgacacagccgaggcccagagcctgaagcccagcaaagccgagaagccactgaggaacggcctggtgaaggacaagcgcttctgaacccctcggccccgcccccgtggacccggccccaccccgaataccccggccacgctccccgtccttggccgcccctccaccccctccaactctgctcctctagggccgccgccacctcccctgggaccccgccccctcatcctgcctccagttcccggccacgccccccaggacccctgcccctccggggacaccggccccgccctcagcccactggtcccgggccgccgcggaccctgcgcactctctggtcatcgcctgggaggaagatgccaccgccgcagcaaggtccctgcggccaccacctcctcctcctcctggccctgctgctgccctcgctgcccctgacccgcgcccccgtgcccccaggcccagccgccgccctgctccaggctctaggactgcgcgatgagccccagggtgcccccaggctccggccggttcccccggtcatgtggcgcctgtttcgacgccgggacccccaggagaccaggtctggctcgcggcggacgtccccaggggtcaccctgcaaccgtgccacgtggaggagctgggggtcgccggaaacatcgtgcgccacatcccggaccgcggtgcgcccacccgggcctcggagcctgcctcggccgcggggcattgccctgagtggacagtcgtcttcgacctgtcggctgtggaacccgctgagcgcccgagccgggcccgcctggagctgcgtttcgcggcggcggcggcggcagccccggagggcggctgggagctgagcgtggcgcaagcgggccagggcgcgggcgcggaccccgggccggtgctgctccgccagttggtgcccgccctggggccgccagtgcgcgcggagctgctgggcgccgcttgggctcgcaacgcctcatggccgcgcagcctccgcctggcgctggcgctacgcccccgggcccctgccgcctgcgcgcgcctggccgaggcctcgctgctgctggtgaccctcgacccgcgcctgtgccaccccctggcccggccgcggcgcgacgccgaacccgtgttgggcggcggccccgggggcgcttgtcgcgcgcggcggctgtacgtgagcttccgcgaggtgggctggcaccgctgggtcatcgcgccgcgcggcttcctggccaactactgccagggtcagtgcgcgctgcccgtcgcgctgtcggggtccggggggccgccggcgctcaaccacgctgtgctgcgcgcgctcatgcacgcggccgccccgggagccgccgacctgccctgctgcgtgcccgcgcgcctgtcgcccatctccgtgctcttctttgacaacagcgacaacgtggtgctgcggcagtatgaggacatggtggtggacgagtgcggctgccgctaacccggggcgggcagggacgcgggcccaacaataaatgccgcgtgg

SEQ ID NO: 12862 - DNA, 3731 bp, Homo sapiens
tccccgccccccagtcctccctcccctcccctccagcatggtgctcgcggccccgctgctgctgggcttcctgctcctcgccctggagctgcggccccggggggaggcggccgagggccccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaaggtgggggatagaggatgcctcccccacagaccctaccccaagacccctagccctgcccccatccccccaagccctagagctccctccactcttcccgcgaacatcacaccgttccccgaccaagccgtgtgcaatacaacagagggaggcaggtgggaattgagggtgaggggtttgggggaaaggggaagcaggggcatagtcagggtggggagtgtttgaagtttgcagatgagaaggtttgacaaaaagacagagagatgtagagacagtgatagagacagaggaacaaaaagagcagcagtgagaaggcaaagagagaggcagaagagacagacgaggcagagacaaaacactgagaaagagactgaaatggagtaataaatgaaagccccacaccaagcctcctttcttccactggcaaggtgaggggcttggtatagtttggggagatcccctgactattcagtaggagaagaaatcaaaaatccattcttttctccttctctccctccaacagtggccaggggaaggggaagtgagggcaggggcaaaaagatttgggaatttttatttatttatttattgtgacttttcatttttttggtatttggctttactggaataggagggcccctgcccactgtgccccgtttatcccttattccccaaaccctgctctccccaacacctactcacttaagcacttgtataaagcctccagggttgggaatgggagtaaagggcaagagggcggacacatgaagtttagtttctaacccatcatcaccctaactcaaccttttctgagccaaatggcttgaattgaagccagttgtcatggaaatagtaagaggttagggtttaagagctggggatgcgggggtgggagagagaaccctcaacatccaggatctatataatgagagctactttaaaccctcaggtccaccctcatgatgctgagttatttagccagagggtgcagcctgcttatgcccaaattccctcagccaagagagagaccaaagagcctctggaatggccctgctcccagcctctatcttcaggtcaattagagagagtatagagaccccagagtcccctgggtctggaaagcgttaggagaggtcaagaaaggagcagtaaggaggctgaaggttacagggcatttgaatccaaatcactgctctgggctagggaatagagccagcagaccaaggtgggaaggattctggaagggggacattttagtctcctaaccccaaagctcagggtggaagaggggagaacaaggaagcagagtgtataattattttttccttttatttttggaatctaacagtacctggcagcagggaggggaaagtacagtggggaaaagcatctgacaaggccagttagaacagaggatgggaaggatggagactcccgggcttggaaggctaggaagcaggcagagactggttgccatttcaagtcactagctaggcccattcattcctcccacaaccctgacccattctcctctggactcactgtgcctcagtttcttcccctcaatggaatgagaaatgacagcacccgccacagccaagagatgaattctgagcacttaccacgggcactttatggacataaaatacctctcgctgtgggacagataaccagggcaccagagtagtggtgaagagatgtgaggcttaagaggagtcacaggcttcagagtacaagttcccctctgcctcccagctggacagtgcctagaagccaaggagttgagaatctcctgatccacaccctatccttacttcaccaccaggcctcttggctccaggcaagagcttagaggatgtcaggagaggtgggggtaagaatcttcagcaaaactgtcactctaagtagagccagcagttacgggtctgataaaaacagtactgaactaaagtaaagcccaagctggtgagcaaaactggatggctcattcttcccaagagcatgactctcccccttggccagttggtggaaggggcaaaggtatgtgaccacccttgagaaggtgatgttggtgagctttaacatcttattcctattcttatagtgagaaagtgaaacaagatctttcagtagaggaatgggcagggctgttaggctcttcagcttgccttcacccatatagcagctatgctaaccccaagcctctctggccctgttcttcatccttccttctgccccaatcctgaaggacaagacacacccggccatcaacaccactcacatttccttggtggaaggaaaggaacagagaagtgaagaacagatacctccctccaaggtcaaatgcctcgtgatcttggcagagtagggattgggcaataagcatcaggtatcttccctctacagattctagagagctggggcattaaatatgggggacacttagaatacagctccttaaataccaccaaa

SEQ ID NO: 12863 - DNA, 1258 bp, Homo sapiens
ccgcggcggcggcggcggcggcggcggcggcggcagcggcgggggtcgggggggagcgctccagccggccagccccgtccgtggcgcccgagccggacggctgccccgtgtgcgtttggcggcagcacagccgcgagctgcgcctagagagcatcaagtcgcagatcttgagcaaactgcggctcaaggaggcgcccaacatcagccgcgaggtggtgaagcagctgctgcccaaggcgccgccgctgcagcagatcctggacctacacgacttccagggcgacgcgctgcagcccgaggacttcctggaggaggacgagtaccacgccaccaccgagaccgtcattagcatggcccaggagacggacccagcagtacagacagatggcagccctctctgctgccattttcacttcagccccaaggtgatgttcacaaaggtactgaaggcccagctgtgggtgtacctacggcctgtaccccgcccagccacagtctacctgcagatcttgcgactaaaacccctaactggggaagggaccgcagggggagggggcggaggccggcgtcacatccgtatccgctcactgaagattgagctgcactcacgctcaggccattggcagagcatcgacttcaagcaagtgctacacagctggttccgccagccacagagcaactggggcatcgagatcaacgcctttgatcccagtggcacagacctggctgtcacctccctggggccgggagccgaggggctgcatccattcatggagcttcgagtcctagagaacacaaaacgttcccggcggaacctgggtctggactgcgacgagcactcaagcgagtcccgctgctgccgatatcccctcacagtggactttgaggctttcggctgggactggatcatcgcacctaagcgctacaaggccaactactgctccggccagtgcgagtacatgttcatgcaaaaatatccgcatacccatttggtgcagcaggccaatccaagaggctctgctgggccctgttgtacccccaccaagatgtccccaatcaacatgctctacttcaatgacaagcagcagattatctacggcaagatccctggcatggtggtggatcgctgtggctgctcttaagtgggtcactacaagctgctggagcaaagacttggtgggtgggtaacttaacctcttcacagaggataaaaaatgcttgtgagtatgacagaagggaataaacaggcttaaagggt

SEQ ID NO: 12864 - DNA, 1200 bp, Homo sapiens
agtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggaggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 12865 - DNA, 1720 bp, Homo sapiens
agaaagcaactagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcggaggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttc

SEQ ID NO: 12866 - DNA, 1936 bp, Homo sapiens
tccagcccggcagcgggtgagagtgggtgctggccaggacggttccttcagagcaaacagcagggagatgccggcccgctccttcccagctcctccccgtgcccgctaacacagcacggccgcctgcagtctcctctctgggtgattgcgcgggcctaagatgtgtcctggggcactgtgggtggccctgcccctgctgtccctgctggctggctccctacaggggaagccactgcagagctggggacgagggtctgctgggggaaacgcccacagcccactgggggtgcctggaggtgggctgcctgagcacaccttcaacctgaagatgtttctggagaacgtgaaggtggatttcctgcgcagccttaacctgagtggggtcccttcgcaggacaaaaccagggtggagccgccgcagtacatgattgacctgtacaacaggtacacgtccgataagtcgactacgccagcgtccaacattgtgcggagcttcagcatggaagatgccatctccataactgccacagaggacttccccttccagaagcacatcttgctcttcaacatctccattcctaggcatgagcagatcaccagagctgagctccgactctatgtctcctgtcaaaatcacgtggacccctctcatgacctgaaaggaagcgtggtcatttatgatgttctggatggaacagatgcctgggatagtgctacagagaccaagaccttcctggtgtcccaggacattcaggatgagggctgggagaccttggaagtgtccagcgccgtgaagcgctgggtccggtccgactccaccaagagcaaaaataagctggaagtgactgtggagagccacaggaagggctgcgacacgctggacatcagtgtccccccaggttccagaaacctgcccttctttgttgtcttctccaatgaccacagcagtgggaccaaggagaccaggctggagctgagggagatgatcagccatgaacaagagagcgtgctcaagaagctgtccaaggacggctccacagaggcaggtgagagcagtcacgaggaggacacggatggccacgtggctgcggggtcgactttagccaggcggaaaaggagcgccggggctggcagccactgtcaaaagacctccctgcgggtaaacttcgaggacatcggctgggacagctggatcattgcacccaaggagtatgaagcctacgagtgtaagggcggctgcttcttccccttggctgacgatgtgacgccgacgaaacacgctatcgtgcagaccctggtgcatctcaagttccccacaaaggtgggcaaggcctgctgtgtgcccaccaaactgagccccatctccgtcctctacaaggatgacatgggggtgcccaccctcaagtaccattacgagggcatgagcgtggcagagtgtgggtgcaggtagtatctgcctgcggggctggggaggcaggccaaaggggctccacatgagaggtcctgcatgcccctgggcacaacaaggactgattcaatctgcatgccagcctggaggaggaaagggagcctgctctccctccccacaccccacccaaagcatacaccgctgagctcaactgccagggaaggctaaggaaatggggatttgagcacaacaggaaagcctgggagggttgttgggatgcaaggaggtgatgaaaaggagacagggggaaaaataatccatagtcagcagaaaacaacagcagtgagccagaggagcacaggcgggcaggtcactgcagagactgatggaagttagagaggtggaggaggccagctcgctccaaaacccttggggagtagagggaaggagcaggccgcgtgtcacacccatcattgtatgttatttcccacaacccagttggaggggcatggcttccaatttagagac

SEQ ID NO: 12867 - DNA, 1239 bp, Homo sapiens
cagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaata

SEQ ID NO: 12868 - DNA, 2383 bp, Homo sapiens
ttcaagccctcagtcagttgtgcaggagaaagggggcggttggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggcctccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaa

SEQ ID NO: 12869 - DNA, 2572 bp, Homo sapiens
cgctgccactggttagcgataatactggcagcgcgaccggtttctgagggttgttcaccttgctgctcagacgctccgagaagcttcaggcagcataacacttacagtagagacagggtttcaccatgttagccaggatggtcttgatctcctgacctcgtgatccacctgcctcggcctcccaaagtgctgggattacaggcgtgagccactgcgcctggccgcaatttacttcattgaatctccaacaagagtcctgtgagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggcctccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaa

SEQ ID NO: 12870 - DNA, 3701 bp, Homo sapiens
cccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcatggggcgagctggacgccggggaggccgaggcgcgcgcgcggggaccccagcaaccgccgcccccggacctgcggagtctgggcttcggccggagggtgcggcctccccaggagcgggccctgctggtggtattcaccagatcccagcgcaagaacctgttcgcagagatgcgcgagcagctgggctcggccgaggctgcgggcccgggcgcgggcgccgaggggtcgtggccgccgccgtcgggcgccccggatgccaggccttggctgccctcgcccggccgccggcggcggcgcacggccttcgccagtcgccatggcaagcggcacggcaagaagtccaggctacgctgcagcaagaagcccctgcacgtgaacttcaaggagctgggctgggacgactggattatcgcgcccctggagtacgaggcctatcactgcgagggtgtatgcgacttcccgctgcgctcgcacctggagcccaccaaccacgccatcatccagacgctgatgaactccatggaccccggctccaccccgcccagctgctgcgtgcccaccaaattgactcccatcagcattctatacatcgacgcgggcaataatgtggtctacaagcagtacgaggacatggtggtggagtcgtgcggctgcaggtagcggtgcctttcccgccgccttggcccggaaccaaggtgggccaaggtccgccttgcaggggaggcctggctgcagagaggcggaggaggaagctggcgctgggggaggctgagggtgagggaacagcctggatgtgagagccggtgggagagaagggagcgcagccttcccagtaacttctacctgccagcccagagggaaatatggattttcacaccttgcctggccaccctggaaaaacaagccaaggaggatttcttttgttctgttttctctctctctctctctctctctctctctctctctctctctctctctattactgtggctttggatttccttatgtgtcttacaggctttgatagaaggggaggggaggagagatgcatacccgtttctcaactgctccatggattgaaaaaataacagtttaaaaagggaaacaatgtgggaggaagaatcaccgttgacgcatcttgatttggttggtttttacatgtgtaaagaaggtggggtctctggccatgtcatagcccatgtcttgtgccctcccacacagaaagtgttagatagggaaattggcaaaaagaatagttaagtcaggaatggtcctgcctatagaagagctttgagagaggtgggcccacgggtgcccctctcacccatttgtgtactctgtgagtttaccagctctgccctggcctctttcggtaccaggaactggcaaccttcatctcactcctgagggcccaggtctctgccttcattgttgctttttctggtgggggcaaggggagctggtatggatggaatgacaagaattagtccaaatggaaccccttgaaggataatgagaaaccacaaggcctgcctctgactggggctgacacggaggtgcattagcccaggctggaggtagcccacccaaatgccctttctgattctaattgatttctttcaacagaatttgccaaaattcagacatgcacttctaaggggaaggtgattttccagttcaaaaaaatgggcaggagtggggaacaaaacaattaacgtaagagctacaaaggagggaaaaggaaccaagaagtagaaggagtcccatcaggagggaagatggtgggcctcagggaggatggggatcaagggacaggccaggagccaggagtggggaagggagggatgaaaggggacacaagtccctgtctctgaagtttctttaaaatctgagttccctcccctctctttgacattcctgaaagattaccagccagcaatagcccagggctcccccaaaagaattggttcagattgtaattatcagttaggcaatgtttttaaaacttagtaatgagaaactgtgaaaagagccaagtgttacattgagcttggggtgggagatggggaacaggcagtgaggaaggagacaggggtggaattcgtcttctgggaggaagctggagagagcacagtgaaattgaaatacccattcccagatagtcaaaaacatgaactttcccccagcctgcaccagtattgttttcaaacattgcccatgagtaggccctttgaagagttagcttcctcctcatctttgactataaaattgtttaatcaatggaatttgtaccagccttttaaaaagttttagtttttcctaagtgattttgctctcttccaatctaaacctgttgcttgtttggttcagagaactacaaactgtcaaagaaagggtggggatgataagaaatgctaatataaaaatgctaagtgaaaaaaagacttggccaggagaaataatttaaaatgcacatttgctttggatgcactgttgttctgttaaggctgtatatatttgtttatttaaggtgactgaaagtgcaaagaggaaatggacagcatgcaattcatcctaatgtacaaaacgttatatgcactcaaatgttataatttctaatatttttaaagtttatattcgagttgtacaaagttaagcattaatcagatatttcattttttcataatgttaccattttcttaaatattattacaaaattttaagtctgtctaatggagagttttttttaaactgtctacctcatataatacaagtatttacaacgctaaagttaccagaggtcaatgaataatcaaaacattttttacagtacacctttcctggatgatatgcaatcgaatgctatattattaaacgcatttttctccttaataa

SEQ ID NO: 12871 - DNA, 1162 bp, Homo sapiens
cccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcatggggcgagctggacgccggggaggccgaggcgcgcgcgcggggaccccagcaaccgccgcccccggacctgcggagtctgggcttcggccggagggtgcggcctccccaggagcgggccctgctggtggtattcaccagatcccagcgcaagaacctgttcgcccctggagtacgaggcctatcactgcgagggtgtatgcgacttcccgctgcgctcgcacctggagcccaccaaccacgccatcatccagacgctgatgaactccatggaccccggctccaccccgcccagctgctgcgtgcccaccaaattgactcccatcagcattctatacatcgacgcgggcaataa

SEQ ID NO: 12872 - DNA, 973 bp, Homo sapiens
ctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcccccggacctgcggagtctgggcttcggccggagggtgcggcctccccaggagcgggccctgctggtggtattcaccagatcccagctgctgcgtgcccaccaaattgactcccatcagcattctatacatcgacgcgggcaataatgtggtctacaagcagtacgaggacatggtggtggagtcgtgcggctgcaggtagcggtgcctttcccgccgccttggcccggaaccaaggtg

SEQ ID NO: 12873 - DNA, 4162 bp, Homo sapiens
ctttgaggccgccgggagcatcctgtggcctctctctgcgcggccacccggccgcggcgcgaagcggtctggagggcgagcccttccgcggccccaactctgccgccccgttcccggcattgggaaccagggcagggagggggcgggtgtttctctgcgggggagtggggaggaagctgggcgggtgcgcgcggtgccccgagcctggaaccacggagggcgcgttggtcttgggcggatggagggggtgtcgcactgccgcggggaggcgtgtcgggaggctggggccagtggcagtcgcttggcgagggtgggggcgtagcgctgcggtgggaggaggcggctccggccctggtctccactctaggccggggtggggggcgcatagcggccgccggagctttcagcagggggcgctgctccgggcgttgggcgggggtggggtgggccaggagggggggccgcgggctggccgcgcacacttcccccattattaaacactatgttcaaaaggcgccgggggacttcccggagccacggagcccgcgccgcccgcccgcccggcccacggagcccatggacctgagcgccgccgccgcgctgtgcctttggctgctgagcgcctgccgcccccgcgacgggctggaagcggccgccgtgctgcgagcggcgggggctgggccggtccggagcccagggggcggcggcggcggcggcggcggcgggcggactcttgcccaggctgcgggcgccgcggctgtcccggccgccgcggttccccgggcccgcgccgcgcgccgcgccgcgggctccggcttcaggaacggctcggtggtgccgcaccacttcatgatgtcgctttaccggagcctggccgggagggctccggccggggcagccgctgtctccgcctcgggccatggtcgcgcggacacgatcaccggcttcacagaccaggcgacccaagacgaatcggcagccgaaacaggccagagcttcctgttcgacgtgtccagccttaacgacgcagacgaggtggtgggtgccgagctgcgcgtgctgcgccggggatctccagagtcgggcccaggcagctggacttctccgccgttgctgctgctgtccacgtgcccgggcgccgcccgagcgccacgcctgctgtactcgcgggcagctgagcccctagtcggtcagcgctgggaggcgttcgacgtggcggacgccatgaggcgccaccgtcgtgaaccgcgccccccccgcgcgttctgcctcttgctgcgcgcagtggcaggcccggtgccgagcccgttggcactgcggcggctgggcttcggctggccgggcggagggggctctgcggcagaggagcgcgcggtgctagtcgtctcctcccgcacgcagaggaaagagagcttattccgggagatccgcgcccaggcccgcgcgctcggggccgctctggcctcagagccgctgcccgacccaggaaccggcaccgcgtcgccaagggcagtcattggcggccgcagacggaggaggacggcgttggccgggacgcggacagcgcagggcagcggcgggggcgcgggccggggccacgggcgcaggggccggagccgctgcagccgcaagccgttgcacgtggacttcaaggagctcggctgggacgactggatcatcgcgccgctggactacgaggcgtaccactgcgagggcctttgcgacttccctttgcgttcgcacctcgagcccaccaaccatgccatcattcagacgctgctcaactccatggcaccagacgcggcgccggcctcctgctgtgtgccagcgcgcctcagccccatcagcatcctctacatcgacgccgccaacaacgttgtctacaagcaatacgaggacatggtggtggaggcctgcggctgcaggtagcgcgagggccggggagggggcagccacgcggccgaggatccccagctgatgagcagcagcgggccaccctgtcaccgagcgtgggtgcatgtccgatgtgacccagcaccctctcagaggagggagagcacacgttcacactcacacacactcgtgcagtcacgcacacatttaccggggacagcatgtgaaagccttgggaagagatgacctgccggtaccgaatgtcaaagccctgtgtattttgcaaacagataaccatggcgcccactgcccccatttagggagaggaaggtgtttgtgctgatgttgcagttagaggcacgaaaatcaggtagcaacaacgggttaggaaattcgaagttccagaatgggagaaccaaaggggtactcgagcatgctttatctcacccccttttgtttctggcccgatgtggggcatcgcttccctggggggctgagcgccgcgtggtgcactccgtgacccactgcaaggctgtaatgcccttcccgagggtttgtgttgcatggggccgtttaccctggaactgctgcaaaaagcatctttctttttttaacttttaaaatttaacgtgcccctgcttcatttttgaaagggaagttttgtctgaaagtagctgttgtggagcttcccagatttctgcaaaggtcggtaccgccacccccccccccccccccgccttttttttttttttttttaatcaattccaataggaaatgttatggaaagtggaaaggatatttttcttttaaacggctgagtctgatctaacaggatattggggtgggataggatctgccaggttcggaagctccccagttggtcagggggaggtgggagccatgcctcgggtggctcaggaggaagttagtgcaatggcccggaatggggaaggtggggctgggggaggggagctactgcttttcctagagacctgccaggaggttttcctaagaagccagggaagaggctctcagggcttgaaaggcaaggaggtgtcctggggcccactccagccgaggactccggcttgccggccaggtaggcggaagctcccggggccgactcgggcttgtgctagttatcaagtaagtcggcctccgctttttacctgctttcgctgtgttgttgctgtagttgttggcagtgtgatagtaacgggaagtgaagccactcaaaaatgcttttgtcagacttcaactcacaacccagacctttagagcagggggaaggtctgccccttcccctcatcggctccctggcttggctgctgtgcccttggaagggcagggccttggtgtgggggagcagaggtggaatatcccccagttcccttatttggccccaaagggtcttattgatgggaggattttctaggcatgtaaaagtgagttcgaacattcagacttcactgtttgatttgatttgtttatgcctgggaatcctttgtggctttttgtcaataggctgggagagggaacctagttggactccagctgtccggggtgggggcttcttagaacagccccgcagccctctcggtgcatctgtgtgatgttgtgtaggactttccccttcagagtcctggggagcattatttccaccctgtgttggatgcaggacaattcatacacattttgattctcagtgattacactcttgagagagagaagacagacttacgatttagatacagctaatttacttaggggccctacctgaatcggttttcatcctgtaaaattctcccaaaagaaaaaaaaatacacgtgtaaattactcttaaaattaagattccccccttcctcctattatgtgaatttatattctgtggctgtatgagtagctataaataaccagaacatgaacagtctcttcaggttaaaaattttaaaaatatccaaaagtggctgctctggtacaattccatcttattttagtgactgggcaaagatggtccctaaatttgtggattttgccagagatgcctcactctcgtttttaaaatgaagcttgtcataatgaagaattatatattaaaaaaagcactgaagtgttgaaagttgtagtattagaaggtttagaaaggaagttaatgacaaagtgcagttaaatgttattttgaggaaggtctggggtatttaatatctttggataaaagcaaacattttgatacttttttagtgactagtaaaaacaattttttgggca

SEQ ID NO: 12874 - DNA, 2784 bp, Homo sapiens
gagggtgcgcccaccggtcccgccgggcgcccgcgggacgcgccgccagggccctctccgccgggggctcggcgctcgcccacctcttccaaatttaaccattacctaaatccgaagggaaatgagcaaacctctcggattgggtgtcaaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagta

SEQ ID NO: 12875 - DNA, 2855 bp, Homo sapiens
agctgagttggggtaacccacccgatgggaactacagctctccagggagtttgattgccggagcgagcttcgctaggaaaggggaggagctggggggcgtgggcagggaggaggaaaggggcctgagacagggccccgggacaggttttaccgctgagctgtgtcagtggcggcggcggcaacgacggcgggttcgcgccacctgtccaagtgccacctggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtatt

SEQ ID NO: 12876 - DNA, 2693 bp, Homo sapiens
aaagcaagattccgtttgaaaactctcctagcgcggtgcccgcgccgtgactccgcaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtatt

SEQ ID NO: 12877 - DNA, 2449 bp, Homo sapiens
tgcgaggctgagtatgatgggctccatccagcacgaacacaaagccctgtgagaggaggcagagtgagatgaagtcgaactgtgggatatgaaaggcattttgaaggagtaggcatcaggctggtttttgttcgaggaaagctactcaggagcttgggaggattgcttgagaccaggagttcaagaccagcctgggctacagagcaagaccccatctttttgaaacttcctgcaactcgcatctggaaaagtgctgttatttgaaagggtgccgacattgtgaaaaacacggagtattgatctctgaagctgagatttttgtcctaaagaatactcaagatgtgtccctggctgggcacagcagctcgtgcctgtaatcccagcactttgggaggctgaggcaggaggatcgcttgaggccaggagttcaagaccagcctattgtgaatagtaccactataaatagagaaagcgtgccgctccaagtgtcgagggttagaaatgagaattcgaagtcttgtgtcctggaaagttttgataagcaaatacggctgagctcccgcgctctcttcattggctgcttgttcaccgccagattttgacacaaataatcagattgaaaatcagggaggggaacagaagaggaaaaacacacagagagacagagcaaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 12878 - DNA, 1653 bp, Homo sapiens
caggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 12879 - DNA, 1515 bp, Homo sapiens
caggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacaga

SEQ ID NO: 12880 - DNA, 2314 bp, Homo sapiens
ctttattgcgaggctgagtatgatgggctccatccagcacgaacacaaagccctgtgagaggaggcagagtgagatgaagtcgaactgtgggatatgaaaggcattttgaaggagtaggcatcaggctggtttttgttcgaggaaagctactcaggagcttgggaggattgcttgagaccaggagttcaagaccagcctgggctacagagcaagaccccatctttttgaaacttcctgcaactcgcatctggaaaagtgctgttatttgaaagggtgccgacattgtgaaaaacacggagtattgatctctgaagctgagatttttgtcctaaagaatactcaagatgtgtccctggctgggcacagcagctcgtgcctgtaatcccagcactttgggaggctgaggcaggaggatcgcttgaggccaggagttcaagaccagcctattgtgaatagtaccactataaatagagaaagcgtgccgctccaagtgtcgagggttagaaatgagaattcgaagtcttgtgtcctggaaagttttgataagcaaatacggctgagctcccgcgctctcttcattggctgcttgttcaccgccagattttgacacaaataatcagattgaaaatcagggaggggaacagaagaggaaaaacacacagagagacagagcaaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatac

SEQ ID NO: 12881 - DNA, 1790 bp, Homo sapiens
aaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggtcttctccacccctcacgggctcgaagtgcatgtgcgacgctcccatagtgggacccggcccttcgcctgtgacatctgcggcaaaaccttcggccacgctgtgagcctggagcagcacacgcacgtccactcccaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacagatttgctgcc

SEQ ID NO: 12882 - DNA, 1652 bp, Homo sapiens
aaaaaggagaagtatctatttgtgcaaagagtcacacagttgacagagtggaggccagtcccgagagaggctttgcagttcccacctcgggaagctccggcagaacccaggcgagggacagctccggacaggtgtggggtgcacactgaaaatgccacgctccttcctggtgaagagcaagaaggctcacacctaccaccagccccgtgtgcaggaagatgaaccgctctggcctcctgcccttaccccggtgcccagagaccaggctccaagcaacagccctgtccttagcactctattcccaaaccagtgcctggactggaccaacctcaaacgagagccggagctggagcaggaccagaacttggccaggatggccccggcaccagagggccccattgtgctgtcccgaccccaggatggggactctccactgtccgactcacccccattctacaagcctagcttctcctgggacaccttggccacaacctatggccacagctaccggcaggccccctccaccatgcagtcagccttcctggagcactccgtcagcctgtacggcagtcctcttgtgcccagcactgagcccgccttggacttcagcctccgctactccccaggcatggatgcgtaccactgtgtgaagtgcaacaaggagcgcagcttcgagtgccgcatgtgcggcaaggccttcaagcgctcgtccacgctgtccacccacctgctcatccactcagacacgcggccctacccctgccagttctgcggcaagcgtttccaccagaagtccgacatgaagaagcacacctacatccacacaggtgagaagccgcacaagtgccaggtgtgcggaaaggccttcagccagagctccaacctcatcacccacagccgcaagcacacaggcttcaagcccttcagctgtgagctgtgcaccaaaggcttccagcgcaaggtggacctgcggcggcaccgcgagagccagcacaatctcaagtgaggctgcgccggctcccagctcctggccagcctgccctgcggtcctgtcacctggaggccagcctcacatgcccaaatctccagtctcctggaggtgggactggacaggagtctaccagcttgttttgagactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacagatttgctgcc

SEQ ID NO: 12883 - DNA, 2382 bp, Homo sapiens
atgagggtcagggctgcgcggacccctatcccgcctgcggtcctcccggcaagcccagcgggagcgcccgctcggctgggtccccgcctccagcggcgccggggccgcccagaccctgggctcagcctcgcgccccggtgcccacctgaggaggcagcggtcccggcctcgcgtcccggatgggacggcgcgggagcaatgccagtggccccgagcgccccgggccacgcgcggggccggccagccgctctcgcgccctccccgccccctccgcgccttgcctcgccgcccgcggcccccacccaccggccgctcctcccctctccccaccctcctcctccgccccctcccctcccccgccgcctcgcagatagctcggccgcgcgtctcagccgccggggccccgagcgcaggcggcgaggccaccacacctgcagagcgctcgggctgcctagccggcacctcgcctcccgccgcgcaaaccccttctccccacgcgccgagtctcccatgacgcccgagccccccggccggcgacaatgaccacttccctgcaagatgggcagagcgccgcgagcagggcggctgcccgggattcgccgctggccgcccaggtgtgtggcgctgcccaggggaggggcgacgcccacgacctggcgccggccccctggctgcacgcgcgagcgctcctgccccttccggacgggacccgcggctgtgctgcagacaggagaaaaaagaaagatcttgatgttccggaaatgccatctattccaaacccttttcctgagctatgctgttctccatttacatctgtgttgtcagcagacctatttcccaaagcaaattcaaggaaaaaacaggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttaggaaaaaaa

SEQ ID NO: 12884 - DNA, 1693 bp, Homo sapiens
attactttcctagttgtttcattgcactgagccctgagattcccaaggagtaaccataaaagatttcttttattttgtccatgacctacgagacaggatcattctaagaagagcaggcatgagtttgagtgcaagaagagtcactctgcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacataggtgtagaaagaacaatagaagaccacgaactggtgattgaagtgctatccaactgggggatagaagaagaaaacaaactatactttagaaaaaattatgccaaatatgagttctttaaaaacccaatgtatttttttccagagcatatggtatcttttgcaactgaaaccaatggtgaaatatcccccacacagattttgcagatgtttctgagttcaagcacatatcctgaaattcatggtttcttacatgcgaaagaacagggaaagaagtcttggaaaaaaatttacttttttctaagaagatctggtttatatttttctactaaaggaacatcaaaggaaccgcggcatttgcagtttttcagcgaatttggcaatagtgatatttatgtgtcactggcaggcaaaaaaaaacatggagcaccgactaactatggattctgctttaagcctaacaaagcgggagggccccgagacctgaaaatgctctgtgcagaagaagagcagagtaggacgtgctgggtgaccgcgattagattgcttaagtatggcatgcagctgtaccagaattatatgcatccatatcaaggtagaagtggctgcagttcacagagcatatcacctatgagaagtatatcagagaattccctggtagcaatggacttctcaggccagaaaagcagagttatagaaaatcccactgaagccctttcagttgcggttgaagaaggactcgcttggaggaaaaaaggatgtttacgcctgggcactcacggtagccccactgcctcttcacagagctctgccacaaacatggctatccaccggtcccagccatggtttcaccacaaaatttctagagatgaggctcagcgattgattattcagcaaggacttgtggatggagttttcttggtacgggatagtcagagtaaccccaaaactttcgtactgtcaatgagtcatggacaaaaaataaagcactttcaaattataccagtagaagatgacggtgaaatgttccacacactggatgatggccacacaagatttacagatctaatacagctggtggagttctatcaactcaataagggcgttcttccttgcaagttgaaacattattgtgctaggattgctctctagacaagccagaagtgacttattaaactattgaaggaaaaggactcaagaaaaataataaaagaccataaataagggcgaaaacattaccatgtgaaaagaatgtatttcacctgcaagttacaaaaaaatagtttgtgcattgcaaataagcaaagacttggattgactttacattcatcatttaaaattcattagttaaaattaaaccttagg

SEQ ID NO: 12885 - DNA, 2228 bp, Homo sapiens
cctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatga

SEQ ID NO: 12886 - DNA, 2146 bp, Homo sapiens
ttttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgat

SEQ ID NO: 12887 - DNA, 1667 bp, Homo sapiens
gacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggag

SEQ ID NO: 12888 - DNA, 2197 bp, Homo sapiens
tgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatg

SEQ ID NO: 12889 - DNA, 2107 bp, Homo sapiens
agttaagggcctggcgtctccctccctgaagacgtggtcccagccgggtgtcctgacgctcggggttcaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgataca

SEQ ID NO: 12890 - DNA, 2197 bp, Homo sapiens; identical to SEQ ID NO: 12888

SEQ ID NO: 12891 - DNA, 2405 bp, Homo sapiens
gctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccaccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgcctt

SEQ ID NO: 12892 - DNA, 376 bp, Homo sapiens
atgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacagtggctgtgccacctgcacaatgaagtgaaccgcaagctgggcaagcctgacttcgactgctcaaaagtggatgagcgctggcgcgacggctggaaggatggctcctgtgactag

SEQ ID NO: 12893 - DNA, 4560 bp, Homo sapiens
gcggcggcggcggcagcggcagcagcagctgctacagtggcggtggcggcggcggctgctgctgagcccgggcggcggcggggaccccgggctggggccacgcgggccggaggccccggcaccattggccccagcgcagacgcgaacccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaacc

SEQ ID NO: 12894 - DNA, 925 bp, Homo sapiens
ccgcgctctctgatcagaggcgaagctcggaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaaattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaagtcaaaat

SEQ ID NO: 12895 - DNA, 4293 bp, Homo sapiens
ccgcgctctctgatcagaggcgaagctcggaggtcctacaggtatggatctctggcagctgctgttgaccttggcactggcaggatcaagtgatgctttttctggaagtgaggattcttctaaggagcctaaattcaccaagtgccgttcacctgagcgagagactttttcatgccactggacagatgaggttcatcatggtacaaagaacctaggacccatacagctgttctataccagaaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttgg

SEQ ID NO: 12896 - DNA, 2173 bp, Homo sapiens
gattgcaggtcctacaggtatggatctctggcagctgctgttgaccttggcactggcaggatcaagtgatgctttttctggaagtgaggccacagcagctatccttagcagagcaccctggagtctgcaaagtgttaatccaggcctaaagacaagaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaatagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatgatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaagatttctactttccatggctcttaattattatctttggaatatttgggctaacagtgatgctatttgtattcttattttctaaacagcaaaggattaaaatgctgattctgcccccagttccagttccaaagattaaaggaatcgatccagatctcctcaaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggt

SEQ ID NO: 12897 - DNA, 461 bp, Homo sapiens
gtgaaggatgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacagcaggaactcccagggatgaagattcctcctgtgacccgggctacctgtagccaaaatgcaactggatccagttaatcctctcatttctgacccactttttcctttgaaaatacaataaaattcccccataccggtgtgcatttaaa

SEQ ID NO: 12898 - DNA, 377 bp, Homo sapiens
atgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacaggaactcccagggatgaagattcctcctgtgacccgggctacctgtagccaaaatgcaactggatccagt

SEQ ID NO: 12899 - DNA, 566 bp, Homo sapiens
tgggaacgccaggcggctgccagagcaaacacccagcccagggcccctggatttgagcagtgcctcggagcagagggatatctgccgcatcaggtgccaccccgggtgaaggatgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacagcaggaactcccagggatgaagattcctcctgtgacccgggctacctgtagccaaaatgcaactggatccagttaatcctctcatttctgacccactttttcctttgaaaatacaataaaattcccccataccggtgtgcatttaaa

SEQ ID NO: 12900 - DNA, 1602 bp, Homo sapiens
ccaaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacaagcagcagaggagatgcccaacaccaccctgggctgccctgcgacctgggatgggctgctgtgctggccaacggcaggctctggcgagtgggtcaccctcccctgcccggatttcttctctcacttcagctcagagtcaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacctgtaaatgaa

SEQ ID NO: 12901 - DNA, 1228 bp, Homo sapiens
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggagggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacct

SEQ ID NO: 12902 - DNA, 1459 bp, Homo sapiens
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacct

SEQ ID NO: 12903 - DNA, 1292 bp, Homo sapiens
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacctgtaaatgaa

SEQ ID NO: 12904 - DNA, 1613 bp, Homo sapiens
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcatctgactctcttttgaggtccctgtatgtctacctctgacttctgtggtccctctgtgtctgctctcatccattcctcttactggggcctggggctctagcccaaggctcagaggagccaataaacct

SEQ ID NO: 12905 - DNA, 1172 bp, Homo sapiens
cagcgcagtcacgtcccagagcctgttcagctgagccggcagcatgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggcatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctggctgtagtggtgtttgccttcatcctctgctggctccccttccacgtagggcgatatttattttccaaatcctttgagcctggctccttggagattgctcagatcagccagtactgcaacctcgtgtcctttgtcctcttctacctcagtgctgccatcaaccccattctgtacaacatcatgtccaagaagtaccgggtggcagtgttcagacttctgggattcgaacccttctcccagagaaagctctccactctgaaagatgaaagttctcgggcctggacagaatctagtattaatacatgacctagcacattgcgagtacagtcaccgc

SEQ ID NO: 12906 - DNA, 912 bp, Homo sapiens
agcgcagtcacgtcccagagcctgttcagctgagccggcagcatgtggaacgcgacgcccagcgaagagccggggttcaacctcacactggccgacctggactgggatgcttcccccggcaacgactcgctgggcgacgagctgctgcagctcttccccgcgccgctgctggcgggcgtcacagccacctgcgtggcactcttcgtggtgggcatcgctggcaacctgctcaccatgctggtggtgtcgcgcttccgcgagctgcgcaccaccaccaacctctacctgtccagcatggccttctccgatctgctcatcttcctctgcatgcccctggacctcgttcgcctctggcagtaccggccctggaacttcggcgacctcctctgcaaactcttccaattcgtcagtgagagctgcacctacgccacggtgctcaccatcacagcgctgagcgtcgagcgctacttcgccatctgcttcccactccgggccaaggtggtggtcaccaaggggcgggtgaagctggtcatcttcgtcatctgggccgtggccttctgcagcgccgggcccatcttcgtgctagtcggggtggagcacgagaacggcaccgacccttgggacaccaacgagtgccgccccaccgagtttgcggtgcgctctggactgctcacggtcatggtgtgggtgtccagcatcttcttcttccttcctgtcttctgtctcacggtcctctacagtctcatcggcaggaagctgtggcggaggaggcgcggcgatgctgtcgtgggtgcctcgctcagggaccagaaccacaagcaaaccgtgaaaatgctgggtgggtctcagcgcgcgctcaggctttctctcgcgggtcctatcctctccctgtgccttctcccttctctctga

SEQ ID NO: 12907 - DNA, 8444 bp, Homo sapiens
gaggcagctcctagtgaaacagtctaagaggtgtcaggctctgctgagtgctaaattagagaaagctgttacttatataacttcctgtaattgcccggcagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 12908 - DNA, 2448 bp, Homo sapiens
gatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaagtatttgtaaatggtgctacccaaatggtagcccttggtccggcagaacctgcatcgccccggagcttatgagaggcgtgaattcatggacccatcctggaatcagaatcaggccccacttctgcatcagaagccctgggtggcaccagcaagtgtttggcaagcccttgagaagcagtgtctttgagaacgtgacctgtgccccaggcaccagctttactccccgagcccagcaggacatctgcatataacacacagccgaagtcagaaaatatatttttggtgactaaatggagtacctggagtacaagataacacacacacacacacacacacacacacacacacacacacacacacacgccacctttgggagctcagcagccccgagaggatttgatagcttcaccgcttcacctggttttacaaatgcggagactgaggtttagggcagttaagcttcttgcttagcatcatgtaggtaaagaatggtggaaagatatttgaacccgacctgggcaattccacctctgagggctgtcctcagaatgaatcttctgatgggctgggcacggtggctcacgcctgtaatcccagaactttgagaggccgaggcgggtagatcactttaggtcagaagttcaagatcagcctgggcaacatggtgaaaccttgtctctactaaaaatacaaaaattggccgggtgtggtggtgatgcgcacctgtcatcccagctactcgggaggctgaggtgggagaatcacttgaacttgggaggcagaggttgtggtgagccgagatcacgccactgcactccagcccggggacagagcaagacactgtctcaaaaaaaaaaaaagaa

SEQ ID NO: 12909 - DNA, 2347 bp, Homo sapiens
gaaagaatcaaagcgcacatcttgtactttgatgcccataggaagggctctcctctggcccctctggctttgtttggagcagaaaacaacaaactgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggcacatcaaatacgaaatccggacgtataaaccagacaattcataaaagagaaaataccagaaggaaacaaatattgaaaagtattcagtctcactcatcatcaaagacatgcaaatcacaaatcaagtcatctttttctgaattaataacccaaatgatggtacccagtggtgcttaggtgcggtaaaaccagcgcttgtccgatgcaccgttcgcgtggtaaactgacgcattcaggctcttgggaagcaatctgatgatatgtagtagctggttctgtaaatccacctttgagaatttaggcgaaggaagtaacgttctatatgtcaagatgtgcattgcagagggatttataaaggtgaatatttggaagaaataagagaatccacaatagagaccttgctaagtaaacggtggtgctcacgtatgatgggacattatggacacactaacagcactctttatgttggctgaaaatggcactgaaactgatgatagggtcatggttaaggaaagaatgcaagacccaaagtttatactgacaatcattgcagctatttgtaaggacagttttaatactaattccagcaatacatgtttttattccctgtcctggagtaggagaaagcctatattcccaggctgaatgttctacacatttaccactgtatatgcacatagggacagtgtaacctgtctataccaccgtagttccagtcctaactttctgaattctgtttaaagaccttct

SEQ ID NO: 12910 - DNA, 8484 bp, Homo sapiens
aaataaagttttttcaatggaaggcttgcagctcttgaggacctgccaaatggaagaaggacagagacctggagccctatggaaagttctgacaccatgtgtggaaggacatggcttttaacacgtgtggtgactggagtagctgcagctgaggacagccaccctttcttcgtctctgctgagcgaaggctacacggcccttcctccttgcagctgtttcaccttctaccttgcgtggagccaggcttttgcaccgaatctgagatgccattttaaacagaagactccatcctcttgaagatgggaaattcttacgctggacagctgaagacgacacgctttgaagaggtcttgcacaattccatcgaggcatccctgcggtccaacaacctggtgcccaggcccatcttttcccagctgtacctggaagctgagcagcagcttgccgctctagaaggtggtagccgagtggacaatgaggaagaggaagaagagggagaaggagggctggaaacaaatggccccccaaaccctttccagctgcaccctctgcctgaaggatgctgtaccacagacgggttttgccaggccgggaaggacctgcgccttgtctccatttccaacgagcccatggatgtccctgcgggctttctcctcgtgggggtcaagtcccccagcctgccggaccatctcctggtgtgcgccgttgacaagaggttcttgccagatgacaatggccacaatgctcttcttggtttctctgggaattgtgttggctgtggaaagaaaggcttctgttacttcacggaattctccaatcatataaatctgaaactgaccactcaacccaagaagcagaaacacttgaagtattacctggtccgtaatgcacaagggactctaaccaaaggacctttaatctgttggaaaggctcagagtttagaagccggcagatccccgccagtacttgttccagttccctcttcccagccctggagagcacggctgccttccccagcgagcccgttcctgggacgaaccccagcatcctgatgggagctcagcaggcaggaccagcttctgatcacccctcactaaacgcagcaatgggtccggctgttttcaacggcaaagattccccgaagtgccaacaactggcaaagaataacctgttggccctgccgcgaccatcggctttaggtatcttgtcaaactccgggccccccaaaaaacgccacaaagggtggtctccagaatctccatcagctccagatggtggctgcccccaaggtggtgggaacagagctaagtatgagagcgcaggcatgtcctgcgtgccgcaggttggcttggtgggaccagcttcagtcacctttccagtggtggcctctggagaaccagtgtctgttcctgacaacttgctgaaaatatgcaaggccaagccagtgatatttaaaggccatgggaacttcccttacctctgtgggaacctgaatgacgtcgtggtcagccccctcttgtacacgtgctaccagaattcccagtctgtctcacgggcatacgagcagtacggcgcctctgccatccagcccatctccgaggagatgcagctcctgcttaccgtctactacctggtccagctggccgcggaccaggtgcccttgatggaggacctggagcagatcttcctgcgctcttggcgcgagtcgcacctgaccgagatccggcagtaccagcaggcgccgccgcagcccttcccgcccgcgcccagcgccgcggcacccgtgacctccgcgcagctgccctggctggccagcctggccgccagctcctgcaacgacagcgtgcacgtcatcgagtgtgcttactccctggccgagggcctctccgagatgttccggctgttggtcgagggcaagcttgccaagaccaactacgtggtcatcatctgcgcctgccgcagcgcggccatcgactcctgcatcgccgtcaccggaaaataccaagcccggattctttccgagagccttctcactcctgcggagtaccagaaggaagtcaattacgagctggttacggggaaggtagactcgctgggggccttctttagcaccctctgtccagagggtgacattgacattttgctggacaaatttcaccaggaaaatcaaggccatatttcttcctcactcgctgcctcttctgtcactaaagcagcatccctggatgtcagtgggacaccggtgtgcacaagttacaatctggagccacacagcatccggcccttccagctggcagtagcgcagaagctcctctcccatgtgtgttccattgcggattccagcacccaaaatctggacctgggatcctttgagaaggtggactttctcatttgcattcccccctcagaagtgacctaccagcagactctgctccatgtgtggcattcaggggttttgctggagcttggtctgaagaaagagcacatgacgaagcagagggtggaacagtatgttctgaagctagacacggaggcacagacaaaatttaaggcttttctgcaaaactccttccagaacccgcatacactttttgtcctaatccatgaccatgcgcactgggatcttgtgagtagcactgttcataacctctattctcaaagtgacccgtcggtgggattggtggaccgattgctcaactgcagggaggtgaaggaggcccccaacattgtgacacttcacgtgacctccttcccgtatgcactgcagacacagcacaccctcatcagcccctacaacgagatccactggcctgcctcctgcagtaatggagtggacttatatcatgaaaataagaagtacttcgggctgtcggagtttattgaatccaccctttcaggacacagcctccccttgctcagatacgatagctcctttgaggccatggtcactgcattaggaaaaaggttcccccgcctgcacagcgcggtgatcaggacctttgttctcgtgcagcactacgcggccgccctgatggccgtaagcggcctcccgcagatgaagaactacacgtcggtggagacgctggagatcacgcagaacctcctcaactccccgaagcagtgcccctgcggccacgggctcatggtcctgctgcgggtgccctgttcgcccctggcggtggtggcctatgagcggctggcccacgtgcgggcccggctggcgctggaggagcactttgagatcatcctgggcagtcccagctcaggcgtcaccgtggggaagcacttcgtaaagcagctcaggatgtggcagaaaattgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgta

SEQ ID NO: 12911 - DNA, 1933 bp, Homo sapiens
ccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaagggctcaggattccgctggaagaatctcagccagagtcctgaacagcagcggaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttcatccccggactcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaa

SEQ ID NO: 12912 - DNA, 1424 bp, Homo sapiens
atgaccttactcccaagcaaagggggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttcatccccggactcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaa

SEQ ID NO: 12913 - DNA, 1688 bp, Homo sapiens
gaggctccaggctgtggctgaatttcgggccttagctagtcagaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggtggggcctgagcccaggacacccaggtctgggaaggggatatgaccttactcccaagcaaagggggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttcatccccggactcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaactgtataaatggatggttttttg

SEQ ID NO: 12914 - DNA, 2775 bp, Homo sapiens
aagatgctcttccgtgacccacaattattggtgactattgcctgtccataacaggaaaagcgattacggattggctgaggcgaagtagtagggcagaaaagtgggtatagctgcctgcacgcacgcttggtgcgtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctactttctgaaaacaattttgtgtcctctcatggagatccttgccgctgaggcaagcatggcttagccttcccattctctactccagcccagaagctgtcagcttgacacgtgcgtgcgtgcacattcacgtacacacatatacaggcttctacacagaaagggagagccacactcccccagtgcagctgcagcccgtccggtaagaatacgaaacacccaggagccacagcaagggcacaggatttgcaaaatcatcttgccaaagggctgttcctcatttacacggtcatccagggcttagaaaaaggctgaatgattggcgtctgttacaaaaaagagaaaagaacctttcgctgcctttgcttctagaatggaagatacttgtgaaagccatttgctgcacaggaaagatggggcagtttatttcacttctaattttaaaagacgcaagtaatggtcccataatacttcatcttgggataccattcccaaacatgttccacctttaagatgccttaagttaatttggtcagaaacaactaaaggcagcatcgtgtattgaagaaaacatgactgggagctccagcgctgcctgttttcacgctgtggggttgtgagtgcatcatcacccctggagctcccgagttaaatggaggctaagaaaagtaatttatcaactcatttctgtgaatgtttgcagtctcctaccgtctcaactacagctgcagttgctaaaaagcacttaactcgtaacctagaggcaatatagcttaagtagcaaaatatttttttacagtaagcttcagtcatccatagtcactataagttggttatcatctgaaatgcttagaaccagaattgtttcaaacttggggggttttcggattttggaatatagtcaagcatggcttaaccacagggatgtgttctgagaaatgcgctgtcaggcagtttttcctgtgaacaccatgtgtacctacatggacctaaaaaacaggtggtggagcctcctccacacctaggctatatggtgtatgtagcctgttgctctagactggagggcacgttactgtactgatactgtaggcaactgttaacacaatggtatctgtgtatctgaacataacatagtaaaggtacagtgcaaa

SEQ ID NO: 12915 - DNA, 1293 bp, Homo sapiens
gtgcgcggcgactgcgacgggcagtggcagtcatggcggctcagtgcgtgaggttggcgcggcgcagtcttcctgctttggcgttgtctctcaggccatctccccggttgttgtgcacagccacgaaacaaaagaacagtggccagaacctggaagaggacatgggtcagagtgaacagctgaaggagactgtggaaaaatataaacgagctttggcagacactgagaacttacggcagaggagccagaaattggtggaggaggcaaaattatacggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagtt

SEQ ID NO: 12916 - DNA, 3430 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaa

SEQ ID NO: 12917 - DNA, 3077 bp, Homo sapiens
gaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaa

SEQ ID NO: 12918 - DNA, 3315 bp, Homo sapiens
gccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgcctctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaa

SEQ ID NO: 12919 - DNA, 5126 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctccaa

SEQ ID NO: 12920 - DNA, 2045 bp, Homo sapiens
gtttcctagaccagtgacaaagaaaggttttaacagcctgggcacagaggagacatagacttctgggaaaagcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgt

SEQ ID NO: 12921 - DNA, 2933 bp, Homo sapiens
atggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 12922 - DNA, 1867 bp, Homo sapiens
atgaagtggcggctccaggagggacgtggtgaggccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaatacactgtgctt

SEQ ID NO: 12923 - DNA, 1394 bp, Homo sapiens
tgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 12924 - DNA, 1850 bp, Homo sapiens
tgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggtgagagggacctggccttccatttctccagaggtcagaaaagagggaggcctgccccagactggcagagaactccttgatcccacaatgggaataaaaccccacttagggtgggtagcggcctgataggcctctggagggtggagagccacggctggcagagaatgggacagaaggcactggccaggggagtgaccacttatttgctgcaggacaaactgcggacaggcgagaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagaataaaaatgttttattgaataca

SEQ ID NO: 12925 - DNA, 1792 bp, Homo sapiens
ggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccgccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgagaaggcagtggctagggagagaggggtgctgtctgccacttgctccctgccaactttctggagaggtgccaaacttggtgtggccaggaaagggcagtcctga

SEQ ID NO: 12926 - DNA, 946 bp, Homo sapiens
cccagggaggaggggcacgggaggagaacacctctttcaggtcccgggaccccagggaggaagggcagagactggactctcaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcac

SEQ ID NO: 12927 - DNA, 681 bp, Homo sapiens
atggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggctgaagatggaaacattgaatataaataccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagag

SEQ ID NO: 12928 - DNA, 2929 bp, Homo sapiens
ctttcccgagccggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctgggtgtgaattcggtggttttgaatgcataaagtgccttgtggacacgggggagttgtggtgcttctgggtctctgggccccgcctgctggcctgagatgccctcatgttgggaagcattccgtgccccctaccccgcctgccctccgtatttcctgcacctgtcagcctgcaccgactgatgagccagttgctcatttgtgctgattaacacccctaataaggggttggggtgcccataacggggtggccctgccgctgactcaggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagaggggctgtgggccatggaactgtcagcgttattctcagaaggcggccgtggcatgggcagggtatagtgaggagtggaaggagacgtgtgcctggtaatatggggcggaatttccactcagctccatttgctggggatttaaagagaacccttgtgctacgccaggcagttaccgagccgaagggagatgatgggccttcgcccctcagtgggatggcagctgagggggccctgcatttgaccgtcgagactgcagcagcgcctttcctgtctgtggtttaagtctttgcagtcaagtactgatgcatccaagccaggcccatgcctggtgtctccctgactgcagaggagccccagggcaaggacagctcagctgctggcagcctgcctggcccatagacatcccccaagtagtctcaggcctctgacatgtccctgaggggcccctaagaaagaaagtggaggggacactccagaggctgtcgtgggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctcaaaaaaaaaaaaaaa

SEQ ID NO: 12929 - DNA, 1547 bp, Homo sapiens
gtgctttcccgagccggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctgggtgtgaattcggtggttttgaatgcataaagtgccttgtggacacgggggagttgtggtgcttctgggtctctgggccccgcctgctggcctgagatgccctcatgttgggaagcattccgtgccccctaccccgcctgccctccgtatttcctgcacctgtcagcctgcaccgactgatgagccagttgctcatttgtgctgattaacacccctaataaggggttggggtgcccataacggggtggccctgccgctgactcaggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagcagtgaggccagctgcttcctgtccttcagaacacttctctgtgctcagtgggagccaggaagcctcaggcttcacgactgaatgcacccaatatccgacctggctgcgtgtttctggctgggctgccgtgtgcacagcaagttaactagag

SEQ ID NO: 12930 - DNA, 727 bp, Homo sapiens
cgagccgatatttttgacgtgaggggccatggcacctgcaaggtgtttctcagcaagattgaggaccgtgtttcagggcgtggggcattgggctttgtccacatgggctggcctgaagcccagccggctactgccacagcgggcttctcccaggctgctctcggtcggccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattcccc

SEQ ID NO: 12931 - DNA, 1427 bp, Homo sapiens
gtgacgtgctttcccgagccgaaaaggtactttgtggactatcggagagtgcttgtctgtggaggaaacggaggcgctggggcaagctgcttccacagtgagccccgcaaggagtttggaggccctgatggaggggacggaggcaacggtggacacgtcattctgagagttgaccagcaagtcaagtccctgtcgtcggtcctgtcgcggtaccagggtttcagtggagaagatggagggagtaaaaactgcttcgggcgcagtggcgccgtcctctacatccgggtccccgtgggcacgctggtgaaggagggaggcagagttgtggccgacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtgggattccccaacgccgggaagtcctcactgctccgggccatttcaaacgccagacccgccgtggcttcctacccgttcaccaccctgaagccccacgtcgggatcgtccactacgaaggccacctacaaatagcagtggccgacatccccggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctgggtgtgaattcggtggttttgaatgcataaagtgccttgtggacacgggggagttgtggtgcttctgggtctctgggccccgcctgctggcctgagatgccctcatgttgggaagcattccgtgccccctaccccgcctgccctccgtatttcctgcacctgtcagcctgcaccgactgatgagccagttgctcatttgtgctgattaacacccctaataaggggttggggtgcccataacggggtggccctgccgctgactcaggtctccgccatgcacgcgtggactctcggatgagctcagcagaaccgcacagccagagccccaggtcagaagtgcag

SEQ ID NO: 12932 - DNA, 1527 bp, Homo sapiens
aggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtgagcagcatttccagttcctcctgcacctgccgtgagccgtggccctggtgggcaccgacggcccctccgcccggctgtctgtgttcacagatggtctcgtttcccatggtggtgtcggggaaatgacgaaaaatcaggtttcccggcagcacagagaacccttccacaaaagtagaagggaaagcaaatagttttactaaagaagcagcttcaaaccagaccgtgagccaccgcacccggcctcctgaattaacattttctaaagatgcttctggcgtgctatcctgaaagctgccagaggtgtcttggctgcattggtggtaataaaattcatactcat

SEQ ID NO: 12933 - DNA, 1186 bp, Homo sapiens
gtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtga

SEQ ID NO: 12934 - DNA, 2208 bp, Homo sapiens
ataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaaaagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttga

SEQ ID NO: 12935 - DNA, 2103 bp, Homo sapiens
tggttataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagagaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccaagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaatttttataaaacatatagcataaaaacttccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaa

SEQ ID NO: 12936 - DNA, 363 bp, Homo sapiens
gttaaccgtatttgttttcccatgcaaatgatagtctgcctgaggagctggttactgacagtgtgggcagcatgactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacat

SEQ ID NO: 12937 - DNA, 2310 bp, Homo sapiens
gtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctgg

SEQ ID NO: 12938 - DNA, 2803 bp, Homo sapiens
agcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaat

SEQ ID NO: 12939 - DNA, 10240 bp, Homo sapiens
agggtgagtggcagttatatagaccggcggcggagcacgcgtgtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaagtaactttggtaaccacttttggcccagatcactgataataggaagaaatacaacttatacttttgtagcttatattaagcatgtggtgggtggaaagaaaagtttagtctgagtcactttggaaaaaaaaattactttgtggtaacttcaaggtcataaattatggatagcctagaaattatccttcatgagtgaatactaaattatacatttcaaaacagaagttcttcctacttggagacttaagggcattaactagatgcagcaatcctcagcttggtgttatcacatactagaggacatttggaaatgtgtgaaatttggaagggttgttggagagacatgcatctggcatttattgggtggggtctaaggataccaaatgttgtgtaaaaatgaagcaaccccattgagaacactgatagtccctattcctgtgggtgggtggagctgtgggattaggaaaactggaatgaagactcattcttttgaaactcagcctcagataaataacaaactaggaaatggaaatctgtttcaagaattgcagtaacatctactctaaggaattagtaatttcactttttattatttgtaccaaatgtatgtgtgtgttgtgtatgttggtgtaaatgtggagaggtggtagcaatacatactgatgctgcttgtaatttgttgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagattttaaaatgaaaattttcatccgtaggaatggcccaatgtatagttattagctactgagcttagaactcttgacccatgagattttttttttaaatttttatttttatagaggcaaggtcttgctatgttgtcaggctggtctcaagctcctggcctcatcagttctcctgccttccaagtagccggaactacaggtgtgcaccattgcacctggcctcatgagtattttagttagataagatttgtttggttcagtgggtcttagttttttaagacctgttaatttgtaattagacatcttgggccttaaactgtatttttgttttagtggtgaggttgggttttactttgtgtattccagcgttctcaactttgtcagatattgctagggaccagtgagatagataatccaaaaataataatttgactttggttgagtatgtcattaccacagtgttagttgaattgcactttaggttagaaaagttaattttcacatctgtgctgcgggttaggtgatattgtcctcagcacaatagatgaggaagaaactgaatcagaacagttaaatgacaggcttccaagtcatccatgtagcaaggagcacatttgcctcccaaactgatgctttttctctagaaccataatgcccccctaattacatttcagtagcatagaccgcaatgaacttcctactgtagggagacttgagtctggaatacattcagaacaaggttaacattacagttcttaatttcctttagggcaaacaagataattaaacttgggttttgtgagtctttttttgatttgcagattatatatggtaacacaataatggtggtttgtttttaagttttttctcatcaggtttgataatttaatgcaaacttcaaatctggatgtgaataataatatttttattatagtataatccaggtgagtttatagaatttgtgttttgtgcttataaactgtcaccttctgatacttttcttcatccctctatttgaaaaacccttgtagaatttaacgatttaatggaaaatgttgcactttatagaaggccattttagaacttacaggtaacctttttgaagagcttagatttgtagaccactgtttatgctgagtgacatttcttttaaatggttgcatttgtcaaatctataaagatgttttttatattgcagttttctttttgtgctacttaaaggaatctttgcaatgctgcatatagataattgttgacctttttagttcagcagtttttaaacttgaagtaacatcagcatttatttgaatatcaggttttagctaactgcctaatgtaccaaaaaaaaattagcaatgtcttatgtgggatgaggggttaagttaaagttgctgatcaagtaatggccgtgtggcacaagatgataactaagaatttctggttctaaggtagtaatgccttttgggatttatatttgtttaatgttgagattctggggaccataggtgggcctgtcaactcttaacagactatagtaaaggagagatggtggcacatgtgagataaaacttgtttatatttacattcttattagtggatagatatcacctcagtacaacactgaaattaaactgccttgttcatgctttcatgtctcaaatcaaggcctaaatgagtaaaaagatgattacagattacctaaaacccttaaccagttttggtttttgattatgcatatgtgttggcttgcaattaggtttttagtttctgtttatgtgacttgtttgaaaacattggattcgtcttctctccacagtttctacttgaacctagtagcttattttaattccctgtaagaggaaaataatatagggaatctgttcaactattcctttaataaatcatgtgacttggccaattacagaaattcctaagtgtagtattttgaaatgtggccagtgtcccagatttgtaaggtacagtgtgcatacagtgtgtcttaggatttttttaagtaaattaaggatgtttaccagaaattattgatttactgaaccaagtatttattttcagaagcccacttttggggaaggttgcctatatttttgatagtaattagatggaagattaaatcctgtttaacctggatagaaacagttttaactattgctgaagttaaaatcactttggggtggggtggggtggctcatgcctgtaatcccagtgctgtgggaggctgaggccagaggattgctcgaggccaggaatttgagaccagcttgggcaacatagcaagaccctgtctctacagataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccacttcggttactcactgtcctcatgctttgatgtcagttgttctcctaaattttaaaattttgttatgaagattggatgtacactgatttggccctttaaatgacattataccaagaagttggtataagggagtaggagatgagaaaactttttgaaaaatcatttggtgcatgctaaggtagcttgtaggacatgtggttttaaaaaattcatggattttgaagaaggatagggtggaagtaaaatttagctgatagcatagggatcatttgtgatttatatagaaaataattatatttttgagtgagaagcatcagacttaaatttttttcttctattttggttattaccaaaaggaacagagaaactctcagaattctttgaatcatagaatgttagtgctggaaaggactaggaagtgacttgtacaaccccttcattttacaaaggatcagagagaattggttagtagagtcccaaatctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactggccagtttgaggtgcttccattggtctgggtaactagccatttcttcctgattgtgcctagtatatcccagacagtttgtttctatgcagaagaattttatatgaaattttcatttctttgcaaaaacttgttccttctttcagttcatgacatcatccatgctaaagtctgagtcatctgcttccatttttgttattccccacatccagtcttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaacaaatgaattctcatttctcgacataaagccttgtctaaagtgagatgttttccaggtcatacataggtttctccctggggtaattggaagttcttgcatataaagttggttaaatagtaataattatgagttaaccacagaaaatttcagaaaactttaatttttttccattggaatcagcatggatatgtgtatatggatggttcaataaatatacttttatatacatgtttcacagaaattttacattccatcttcaaactgcagaaatagattttttttttttacaagccaaaaaataactgccataacttttgtgacttcatgcaaaaaaaggggggaagagtaaggggcaaaagggaattagttgttcaaggttgagtgtccagtaagaagtaaaaatgttacattaaggaagcgattgcttaacacgctgcttaaggtggtagccagacaaatccttaactgcagcattaaggccataccaagtttatacatatatacaaagaaatttccatataaaagacatactatcacattttcttcttcataaggatgaggaactttgtaattctgacctgattttccaggccaattaattaaaatgtccccaggctgctttttagaagtatcttctactttggctagctgtcagagttgccgctatgtgagcttgtgacttctggtctggcgtgaaagtatgaatcatcttgaacctcttccatcatagcactatgttgctgagctaattcatgctgcccagctaagcacattttctacatccccaaagtatttggaatcacagcattgtaacttgtgattgtcttacctgtaacagactccacagtcatgctggcattgtgacctgaagaattacacagtgcccttcttagattctttggggttaaggtaacttcttgaataatgtactaatgaacgatagtgtttcaggaaacatgccctagctattggaagttcgtatctaacttttaccccttgtgtgtcatgatacatttaagttggtagctacatttttggaataaaggaaatgtaaaattatttgcagaataataacctgggatttgctcttctgcctaaacatcgaactagggaactttaaagacaaagggtgcatcttttgtgcaagtatctaagcgggcaaaatggggaaaacatgaagggcaagtcctttggggatgacttctaattaatgcagaagtcatttgctttggccaggttgggtgggactctgagattgcacactcttgccctgttggcagaaactagcccatcttaagttagtcaatgaatcctgagtcaaaatgaaaggttgctaaatctaagatcgagtgtataaataaaataaccccttcctccagtgactgtgcatttattttgtaataaactcattttggaatgttttagcaatgaa

SEQ ID NO: 12940 - DNA, 754 bp, Homo sapiens
aacggcctcgcggggcaggagtaagccgcggccgccgcctgggccccagggcggtctctggggccaggggtcccgcgcccagcgtttcccgcccgccaccctctccgccacgcgcccgcggcaccttttcctcccctggccaagggatccagtcggttcggaccagaaggaggctttcgtttagggtgggggcagcactaaagtctgattggagtcttgcggtccgcgcgtcgcagaagcgccttcggttttgcagagagcaaagagggagcagcgagtgcacggagtggtagtaacaaccaatgttctttccacgccctcactgtgtgtccggcactgtgcggagccacttttctgcctttcatttgattcttgcagtgagctggcgaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttg

SEQ ID NO: 12941 - DNA, 2700 bp, Homo sapiens
gtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaa

SEQ ID NO: 12942 - DNA, 530 bp, Homo sapiens
gcgcccgccaagaagcgcctggcggaagggcgcactctcaggccttccaccggcgaccttccggcgggagcctgcgggcggcgcaggaacgaccctccttcctctgccccgcagcagtgctgagtaatggtgagagcagcaaggcccttggccgccgcacgttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagg

SEQ ID NO: 12943 - DNA, 580 bp, Homo sapiens
gtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgagagtctgaagaagaagtagaggaacctgaagaaagacagcaaacacctgaggtggtacctgatgattctggaactttctatgatcaggcagttgtcag

SEQ ID NO: 12944 - DNA, 535 bp, Homo sapiens
acaaagggagcctcgccacacgcccgcggccgcctcgcagcgcccgccaagaagcgcctggcggaagggcgcactctcaggccttccaccggcgaccttccggcgggagcctgcgggcggcgcaggaacgaccctccttcctctgccccgcagcagtgctgagtaatggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgagg

SEQ ID NO: 12945 - DNA, 1763 bp, Homo sapiens
ttatatagaccggcggcggagcacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggttcatcttgcactgttcctggcccagtccctattcttgaatcagctgttccttcaaggaggcctggttctttttagttatacttatgaaaggacgacaagtttatgttgaatgattgcatttgtgttttcttccggattggtctagactgaacaagagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttt

SEQ ID NO: 12946 - DNA, 6783 bp, Homo sapiens
aagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacaggtgataatcatgacagagatttgagtagtaaacttttatatcatagtgataaagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcgcgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgc

SEQ ID NO: 12947 - DNA, 3190 bp, Homo sapiens
gggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctataggtaaagagaatttctcgtattggagctttctcttaaatctaatatttcattagcctttgttattgctgagtgttttggaacatatgtttaagtacttgggaaagtctttctcttcatgtttactgatggtatttcagtttttagaaatcgtatcagattagttaaggtttatcagtagtctttagctttgcctacatacttttcataattaattgaagtcatgctatccacagtatactttctttaaattttattgtcttttcttgaaaaaattttggaaatgttataagtagtcatctttaaaactatgtagccctcagcctggtgtggtggcacgtgcctgtggtccctgctacttgggaggctgagatggggagattgcttgagcctgggaggtcgaggctgcagtgaaccatgattgtgccactgcacttcagcctgggtgaccctgagtgagaccctatctcaaaaaaaaaaaaaattatgtagccccctcctttctacaaagttctaaataatataataaacaatattattttagaagtttccatcaataaagtggaaaataatagtattttctattattttcattaacaatcagtcttttatcaactgagctaagatatcttaatattacaaaatgaagcaaaagtttcattttattttttcaagtttgtttatttaagaattctatttaattaagccttatttgcttggttaacatttgctatctatctgtctataaaaaaattaattgagcatataccatgttccatactgtgggtaggcactttataaatgttgtttcatttaatccccacagaagtcctgtgagagtggatgtgtcttgcacatgaggcactgtgatagacactggatacaaagaccattaggacctgcccttactgtcaagttggctgttgatagtttagttagggagagcaagaagagactagtacccttcagcatactaagcgttctgaggagataaatatgagggttatggtgacacctaacttagccaaaatggtagtggtatcaggagaagatcttggagcaggtgaagtctgtttgcactttgtgatgaatgggagttagacaaagtaaacaagatgaggaaaaagtgtttaagccaggggaacaggagtattttagtgcctgcctatttataacgaggaactcagcaacacttagtgaacatagttctttttaatttatgcattttgaagagagggattttacttttaaacttctgtgagctaattttttaagaactgccagtttcttaaaattaatctaccttatatttaacgtaatgtggaattgtatcaacaggagtgtggcatcatactcttcaagtctttgtcttattgtatcaccccaaaatgtcagttttcaaaataaaaaatagaaaaagcga

SEQ ID NO: 12948 - DNA, 6861 bp, Homo sapiens
aagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacaggtgataatcatgacagagatttgagtagtaaacttttatatcatagtgataaagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcgcgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgc

SEQ ID NO: 12949 - DNA, 5207 bp, Homo sapiens
aagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgata

SEQ ID NO: 12950 - DNA, 2512 bp, Homo sapiens
gcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaa

SEQ ID NO: 12951 - DNA, 2490 bp, Homo sapiens
tttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctataggacaacagttagcagccatcactgcctgggattcctcagctaccaatattacctctcatattacagtagtaaccccgtttgcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttag

SEQ ID NO: 12952 - DNA, 2332 bp, Homo sapiens
aagccattcaacaaatctctaggaagttccatactttcccacattttcctgtcttcttctgagccctccaaactgttccatcctctgcctgttacccagttccaaagctgctttcacattttcgggtgtctttttagcagtaccccactctcggtaccaatttactgtatttgtctgttattatgctgctgataaagacatacctgagactgggcaatttaacaaaagaaagaggtttaattggacttaacagttccatgtggctggggaggcctcaaaattatggcggaaagtgaaaggcacatttcacatggcagcagacaagagaagagagcttgtgcagggaaattccgttttttaaaacaatcagatctcttgagacttagtatcacgagaacagcacaggaaagacatgcctccatgattcaattccctcccacaacacatggaaattcaagatgagatgtgggtggggaatacagccaaatcatatcaatttctaagcaacatatttggatatttactctggaaatgtagttacaaatgagcagttccaaatagaagagtgcaatttacttcagctttgcacaaaagcaggtaaagaggtatgcctatattttgaggctagaacaactagaatatcatatttcttttcttagtggtgataggaaagcctactttcctggaccagagaagcagatgtaagtagccttaggaattgctgtgctttttctgctgccagtcccctgctcatgattatggagaaaaatgtaactgagatgcttaggtagtgaggaggcttcaaggcttagggaatgggcactctagtaaatgtgacatttagactataagcaagtaattggtgggggatgtttgtgacctagtgacatataacctgtatttgttgttattgttggtcatctgtagctgtcaatttcctattaagtatgaggtcctatagctccagtataaaatacaccaagtatgcagaggggcttagtaacatttagtgaattaggtaactaagtcttcagccccatagatcctcccaaacaaaatgcaaaatgggtgtctgttctgcagctggcaccatgatcagtctctaccatgtctgcagcctgacatgctactttgtatatgtgctactgaagagagcacagacatgctactttgtaaaaccagtctgtgcagtaatttttctaaagaaaagttaggacccttattcttcaaagagagtatgcactgaatatatctgatgtcatgcaaagtatttttccttttagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtat

SEQ ID NO: 12953 - DNA, 582 bp, Homo sapiens
agcgccgctgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctgga

SEQ ID NO: 12954 - DNA, 3163 bp, Homo sapiens
gtggcggtccgacagagtcctccgtgtcctcccccgcatgacccccttgggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaag

SEQ ID NO: 12955 - DNA, 5309 bp, Homo sapiens
cggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacaggtgataatcatgacagagatttgagtagtaaacttttatatcatagtgataaagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgat

SEQ ID NO: 12956 - DNA, 3720 bp, Homo sapiens
gcgctggcgtggcggcagcgccgctgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccattcaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaaggtaattttataaaatattagaacgctgtattagcaataagaagcaaagccccagaatctctttcagagagccaatgtctcaactcctctgtaagacttgctgggcttaagtttctagctactttgagggtgtagaaagtggttccactcagatgaatgctaaggcagagctttagaaatgttcttgttctttgcaggaagtgatagtggtttcataaatggaagtcatgcctgtcactattgtttaaatatcatataccattgaagttaaacatatagaggacttctgacatatatattgctattaattattgcaggaaaatgggacgttattggtaattaaacattgaaaactcatcctttacattcctggaataagttgaagctttttatgtctatgttcattgagaatgtttatactgtaaatatcagtgagtgtttattttggaaggtagctgtataaaattgtttacttttttggtgaacagcctggcatcatttgagttggcaaaagcatctcttcctgaaagaagagagcatccaggagtaaagctagaaacttattccaaaggcctcttctcagcacggtggcactcaggaa

SEQ ID NO: 12957 - DNA, 4420 bp, Homo sapiens
agcttcctgatttctgaagtctgagtgatttcctccgtgtgccgagaggaaacagccttctgcactcacagccgaagggaaagcagcaggttggggcttcttgtggccaacttcagagcctgtcaccaggaaaggtaagcatgggaggaaggaagatggcgacagatgaagaaaatgtctatggtttagaagagaacgctcagtcccggcaggagtccacgcggaggctcatccttgttgggagaacaggggccgggaagagcgccactgggaacagcatcctgggccagagacggttcttctccaggctgggggccacgtctgtgaccagggcctgcaccacgggcagccgcaggtgggacaagtgccacgtggaagtcgtggacactccggacattttcagctcccaagtgtccaagacagatcctggctgtgaggagagaggtcactgctacctgctctcggcccccggaccccacgcgctgctcctggtgacccagttgggtcggttcaccgcccaggaccagcaggcggtgaggcaggtgagggacatgttcggggaggacgtcctaaaatggatggtcatcgtcttcaccaggaaggaggacctggccgggggctccctgcacgattacgtgagcaacacagagaaccgggccttgcgcgagctggtggccgagtgcgggggccgggtctgtgcctttgataaccgggccaccggccgggagcaggaagcccaggtggagcagctgctggggatggtcgagggcttggtgctggagcacaagggcgcccattactccaacgaggtgtatgagctggcgcaggtgctgcgctgggcaggccctgaggagcggctccggcgggtggcggagcgcgtggcagccagggtgcagaggaggccatggggcgcctggctgtcggcccggctgtggaagtggctgaagtcccccaggagctggaggctgggcctggccctgctgctggggggcgcgctcctgttctgggtgctgctccacaggcggtggtcggaggccgttgcggaggtcgggcctgactgacagcgcaggtcctaaaactgaaggcaacttggttaagggaggctgaattcttggagctgaagggaaaacttcattccaacggaaggaatcctgtagtttcaggcatagttttaatgacacagaaaactttgctgcatcacctttgcaactttgccaaagctcagagttcactttttaagtttttaactcattttaaatgatgtgtatgcagagttttaaaataaattcgtctaacaataacttcctttggtagttttggtagtctaatgtcaagtagcttgtagtggggacaaacgcatggcacagggaaaacaagtgccattattttcgagctttttaaaaaatttagactgcccctccttgataattttctagttcttatacatgggtagataggttcctttgtgatccttgtagacttttagcatcaataaaagaaatgtgggggttacacacgtgaatgttacttctgagacatcagtttatagtacaatgatttactaccaaaaagatgaatgtaactgtactgttacaaagtggaaaataacagtttccacttttctagaacatattatggttcatggcattccaaaatgaagtaagggccgggcgaggtggctcacgcctgtaatcccaacactttgggaggtcgaggcaggtggatcacctgaggtcaggagttcgagaccagcctgaccaacatggcgaaaccccatctctactaaaaatacaaaaattagccaggcgtgatagcactcgcctgtaatcccagccattcaggaggctgaggcgggagaatcacttgatgcagtgagccgagatcgtgccactgcactccaggctgggtgacaaagcaagaatctgtctcaaaaaaaaaaaaagaaaagaaaagaaaaagaaaaagagtaggatattgggaaaataacatataatatcttctatatggttattcatatttttatcacacacacacacacacacacacacacacacagtctgtatctcgagctcctctctggttatggagaagaggcagagcaccaggtgcataggctgagactgcagacacctgagcatcctatgctgtgaggcgaaagcatccggttttttcgggatgggcctgtccaggaaggttctcgaatgccacgtgattagaaaatttgccgctgactggttgtgcgaatcaaacaataggatttccttatttctatttctgagcataatgagaaccctttaagggaactcattgtctttaaatcagccagcctctagtgaggtcatggagacatgggaagcaggtattcacattagctctattcaagaggaagaggaggagggagtgtgcgcaggcgccctagggtcttccccagcacacgttgggaagaaggggtctgcaagcatgcgcacaattgccagctcaggctaaggactgcaggaggttccaggtgggttgcgggcttcgggcaggctatggtgaggggtcctgagggccttggtgaccgctgcagggagttggactttttgaagcgtggctcaagaaaaacccatgtttaattcctgcctttcgcttcctcagcagcctttctgggcccaggcaggggcctcgagccagggaaggatcctttgatgaccagaggggacagcagggagggcacagcgtggtcgtccacggtcacttgcgcacgagccagtgctgctgctggtgttagacaacaacttttatcaaagtggtttaatgtacagcagcaacaaagctgctttgtggagcagggctcccaataggcagtgtgcccagagtagcagctcggaagcagtactgcaatcacatttatacccactttcaactatatgcaaatttaggggtggattatgccaaaatttctagaaaaaaggtcgtaacttccaggtcgtgggattgttgctatggaaaggagccaaaacttccagctgttgccttagcaatggtaacctgacgtggcactggtgagtgtgttttatggagagactctttcacctcttccctttcagcttgtcttcagtgtggtctggagcccaatccccacctccagagtctagtcctgcctcctacctcagtaataaaaagtagtagtatatggttaattgtcaaatacatttgcaaagtgtaatcaaagatacattaccaatctgaatctcaaaatgtgctatcatctttgaatttgaataatgtattattaaagaagttacagttttcctttacattcaataacatttctttagtggttttctttttcagatactttgattatgatcttttttttttcatctttgtatccccgttatacaacccagtgcctggcatagaaagtgggatcaacaaatgtttggaaaatgaattgtaaagttgactttcctgtacctttttaatattagatttctagctaccagacttttgaccattttctaaattttctaccatagataacagaaaattctttcgcgcaagcatgtcattgtattaatgatattctcctgccctaaggaaatttacttcccttcaagcacagggtcccccaaattactgtatttccacccctttcagcttattttatccttttctcctgctacagaacagttggcattcaccattcccttcggtaaagtctttttttaggctgtggcttaaaggttgctttttcccccatagctcaaggttaggccttgtgacctcacttatgtaatttgagtgatttgatagcacaaatcaattttatacttaaattacagcataaaacagcactgcctcctgttggaaaaacttgcttgctaattttaaccagacacagtaaaaatactgtccaatacctcaaaaattgtgtaaatatatatccatttcaattgtcccccttcctctcctctccttttatctcttggaagataaaaatgtatgggtcctgtgctgataatgtttctgttcatatttctatgccctggtacctggatcagcttttgttctacacaaaaagacttgtatctggcttatttctgaaagctagtgttggccatgatgaacttttagagcaaaagatttcaggcagagtacattcttacatattcttacacaatcaatattcagttccagcccgcacagtagccctagcaaatgccagtgctccttccagagattcacctatggattcagtaccccagaagagaatttctgtaaattcttggggaagctatagctagactatggctcaacactcatttttcccccatgattcttaatctaacagtggcaatgttggcctcttcttaggcaactagattcggttcttgcttattctgccaataaaatactttattgagatgcttacaaa

SEQ ID NO: 12958 - DNA, 1449 bp, Homo sapiens
gttttactttctttttctcttggagctgagctataagacaacaggactgaacagggagccaactgtttctttgaacagtaaatcaggaacaccaatggaccaaaatgaacacagtcactggggaccacatgcaaagggccaatgtgccagcagatctgagctgagaatcatcctggtgggcaaaacaggaactggcaaaagtgctgcagggaacagcatcctcaggaagcaagcatttgaatcgaagctgggttcccagaccttgactaagacttgcagcaaaagtcagggaagctggggaaatagagagattgtcattattgacacaccagatatgttttcttggaaggaccactgtgaagctctgtacaaagaggtgcagaggtgctacttgctgtctgcaccaggaccccatgtgctgctcctggtgactcagctgggccgctatacctcacaggaccagcaggctgcacagagggtgaaggagatctttggagaggatgccatgggacacacaattgtcctctttacccacaaggaagacctcaatggtggctccctgatggattacatgcacgactcagataacaaagccctaagcaagctggtggcagcatgtggtgggcgaatctgtgcctttaataaccgtgctgaagggagcaatcaggatgaccaagtgaaggaactaatggactgtattgaggatctgttgatggagaaaaatggtgatcactataccaatgggttgtacagcctaatacagaggtctaaatgtggacctgtgggatcagatgaaagagtaaaggaattcaaacagagccttataaagtacatggaaactcaaagaagttacacagccttggctgaagcaaactgcctaaaaggagccttaatcaaaacacaactgtgtgttttattttgtattcagttgtttctcagattgataattctgtggctttgcatactgcacagcatgtgcaatttgttttgttgcttactctttagtatgtgcaatttattctgcagtttgctgtttattatacccaaaaagttaatgatatttttgagaacagttattagactagaacgcaagactcctaggttatagttacagatcccagttattatttactcactatcatttagtgggtgaatcacagtaatttccctgtaaaatgtggtacctgaagtcatatttgagattctatgaaatgtttaaatctgaacatcactccaattattaatgaaccaaatcatacgataagttactgtttgcattgaaatataatatcaaagccttttgaaatctgtaaacataaaattcctctcattttcaaatatctaaagccagttttatgttcctaaaatctcattttcttctttctagtactactatttctactgaatataatgaaaatggcaataaaataatattacataaactgtaaa

SEQ ID NO: 12959 - DNA, 2058 bp, Homo sapiens
aaagttctattagagctgctggatgatcaggtgggcaggtcccttgcacaagtaaatctggacagctcctcccctcacttcctctcttctcctgtttctcaacatcctggcttagtattgtgtgcaaaatcagagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctttctatgttggcagataatctccccttgtagcttccactcacttattcttgcattcagagtcacaatgatcatcttacccatgtggtttttgagaaagaaagatcaattctttgtttgcagtaggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctca

SEQ ID NO: 12960 - DNA, 1000 bp, Homo sapiens
gtgcaaaatcagagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaaga

SEQ ID NO: 12961 - DNA, 552 bp, Homo sapiens
aggtaagggaataggggtgtgtgtggtgggggtcgggacgaatgtgcgattttggtgaggagggacctgtatcttaaatcgtctggagttcaagcgacaatggcagcccaatacggcagtatgagcttcaaccccagcacaccaggggccagttatggtgagagggcattcagtgctccccagaccaggctgcagggagggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatc

SEQ ID NO: 12962 - DNA, 2291 bp, Homo sapiens
atgacaggaagtgacccgttaaggaagcagcacatcgctgcattcggctggttttcagggtcttgttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacattcctttttatcctttaaatctgttggaacttcccagtccacatgcttcctttgagcaagtggcatctagaataaaggaacagggttggcttttcttgttcctaaaattaggaagaacctcctgctcctactgaagtgcctgccacatagtggacattccctgaactctgagtaaagcaaaacactttcagatggatggattgcattgacgaatgggagtgggagagggtcaaggaaatggggtgccctgtacgcagggctttctctgtgctttcttctcagtttggccaggggcccaaaagaaacacagctcacatttcaatgctctgcaaggaatcactttggcaaatgttcacacatgagaaaggttaagcaaactctttctccttctccactgtaaaatgtccttggatcaac

SEQ ID NO: 12963 - DNA, 1633 bp, Homo sapiens
agccaacaccagggtgtcctagtccgcagaggtgtgggggacacactccataatctctacttttctttttgtgcagctgagtcatggagctttcagccccagcacatggctcctccttaactgcgtctgctcaacctccctcagtgactgccaccctggaggacagggcacaacaaccgtttctggagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctgaaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagct

SEQ ID NO: 12964 - DNA, 3440 bp, Homo sapiens
acttcctgttcctccatctccagcggacactgctctttcaagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattgcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactataatgtgggagccaatttttgcctcagtcttcatttttatatttaccttgttattctcaggcatttttttcttctatgtgagagttaaaatcattctgtaatttccccccaaaatcatattggtattctagttggcaatgtcttacatttatgttaagtttgagggaattggtagttcaagtataagttaattaaggccattttatttctaagtgaacagacttgaaactccagagctactgaagtaaaagttagaatcatttgcattttcattcagataggagataattttgtaaattttgatgctattattttaactctattagcttaagtaatgtcataatagaaaacacaagcatttgaccaaatgagatccattcagcgactaactggcaaggcactcaaaacatgtcattcattaaatgttgtttttatttacctcaaa

SEQ ID NO: 12965 - DNA, 4450 bp, Homo sapiens
caaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtaaaatgaatgaggagaggggagcaagtgggaaacatttggggtgcaggtgggacacagctccaccaccatagtgtgcttggagaggaagctgacgtcccccagtcacagaaatttacccgcctcagccaccatcagaggcctttggggtagggcccttcttatcactagccaaaaataagaaaaaagacccctggataggtatggtagataaaaggaggcgagaaatagcaccaatgactaaatcaccatgccagtcccaaaggaaatgctttcacatggtagatgttcttcctcaggatggatgtgctgacagtgcgtgtgacgaaaataagtggccttggactgaggcttggatgccaacagaccctgtatgggtgtttggctgactccgaagtggagctgtcacagttgtaagtttgaaagcgccttgtgcacaagcagaatgtacttggctgctgcctcagatctgggctctgccttatcgagggcgtccctttcccaaaagccattgcacagggtcaggcgcttaactttcatgggctcaacttcgtcattcatcctggggaggcaggatttacaaatgctggaaacccagccctttcctggccagaagaaatgatttgtgattcattatgtattttaatatgaatgaccttttactttatgaacttaaatggcctgagccatctggaaaaagccacgttaacctactacaatagggacattaccaatacctgtgtaacacctgtttgaccttttgttatagcaatcaaggttagctattcttttaagaatcctctccagagctcaagtgatgcatttggctttagtaaagtccagtggtgtgtgctagctccaggctgctcagatgggggttcctgtctcctctggctctgcactgggctaggtgggtggggatgaagatctactgcccagacttctgcccattcattcaaattccttccagccaccttggggaagctggagggggcccaatgtcactcagttagaattggcacgtgggtcagagccaagggtggctgtcaggccacagcaaggcctgttggtgcccaggagattcaggagatggccacgcccatgctgccacatgccagcttcatgctttgtcatctgagatacatcaatgtcttcagtggggacaagactgggaaaccagctattacttgtcacttctttatgtgctctgggtcttgggacccgcaaggccaggagaagggaattcccttcctgccttcttccccagtcatatctaaaaaccttggtattgggtttcttggtgttctattggccaagtctcgctcttctttctaggctctgctcttgcactgggagagaacgttcagccccaccttcaaggatgtgggcccagaatggtggcccagcgctggtttcagggcagatgttggtcttttacaatctgcccctgcagtctgggggtacacccagaggctcctggtgatgacaagatggggtacatgggcccttaccccagttccctctgctttctttggatatttctaggtctaagggagaaagaacagaagaccccaaggagactgaggctcattctcatggggaaaacagggagtgggaagagtgcaacaggaaacagcatcctcggcagggacgtcttcgagtctaaactcagcaccagacccgtgaccaagacctcccagagacggagccgagagtgggctgggaaggagcttgaggtgattgacacacccaacattctgtccccccaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcacccccctgtgtccagccctctgtttctctttccatcccatggagtgcttcccagtctccaggtcatgacgtctggtgtaggaagaggggcatggggcttgaggacagggtccagcatgcccagatcacattccagttccttcattccttcttccagaacatctgggtcctccctcctctgtgccccaacagcacgctgtcttcctattggaccttctatctcattgcattgcctttcatgagttacttgtctatactctgatagaaccaaagtttcttgagggcaggcctgtatcttttacttctgtgtaacttccacagcttttgactgcattggagtcatgcagtcacgtttggtgcggcaactccatgcaagctgttgaccagatgacttctcatctctccccacaccatgatggtttaaggtgcctgttgtgtctggtggctggaacatggcagtggtgctgagacatggggagggttggagactgggtggggagggttggagactgggctgggaggagagcaagcaggaacagggatggaggcaggaggagcagcccttttattcactcttgagctgtaacaaacaagccccgttggaacttcctagtgggaatgatgggagaagtttggggcagggtatccaagaagtcagactgtggtcaagtaggtggtcccttgccctggctacagaacatggaagcccctagggatgcaagtggacttgggcagaggaggtcacaccaccccaccaaggtagacttagattagagatgacttgcatctgttacttcccctttttccatgggtttcatggcccctcatgatatttgccttctgctcctagaaggcacagactactttcaacctgcctcgcccttcactgccacccctcccttctcccttgataatgggagcatgtggatggggtgtctgcgtgtgcaaacgggttccctagcaaagtatttgtgggggtccaatgcaaggaggcagggaagaaagggggcctgcaaaggaagcagtagagtgacttaaacatcttgcgaggcagcctgcctggtttatgggagaactctgaagcccatgatgttttcctggaaggctgttcctacagacggggtttataagtactgatactggacaggatgagaagggagtaggatgtcatcctgtctcaggcctcggataggaagctgcctgccagcaagaggagactgatgtgccccgggtgcaccccacctcctttgaggtccaagatgctcctggggagttgaccgacatttgggaagataataggaggcattggggaaactgctccccaatatattcctcttttcctttcttcaagctgcgtagcagggggcctttagctagtttctcccgagaggggcgggaagtacagctggtggagacagtgctgggagatgatcagaaatctcagggcacagcctcaggtctacctggacactcatccactgttggagatgctcaacagctagacacagatgctcacagccgacctgtggcctcttgctctgaagccatcccccatcttccctagacacagcagacatctgagaaagcttcagcatttctcttgctaacagattcagaaaagtgtctcaaagcagagcacagagttatttggtgtttgctgaagacagcctttgtgccacaatcacttattaaataagcgatcaatttcccattgaactgaacatgcaacatttatcatacattcagttctcattcacactccttaagatttggtcagaatttttatttctgttcatgtcttctacttttctactcctgtatgaataaaatattgatttgattacagtggctttgactat

SEQ ID NO: 12966 - DNA, 876 bp, Homo sapiens
aagggcaggtctccagcccagctctctgaaaacattttgctgaaaatataagcaaacatcggccttgtcctccttgtgttcatacactgtggaagcttttctctgcctcctccgtgagagtgcgtggccgggagaccagaaacgtggtcctttctcttgcctgtgagctggtgcagagatggaggaagaagaatatgaacaaattccccaggagaatcccccagaagagctgtcccaggatcctgtgctggagctgtcaggaggtctcgccagaggtggcagacgctatctgccaagccatcgtcttatccgccccagggccccacgccgtgctcctggtgacacaactgggccggttcacggatgaggatcagcaggtggtcaggcgcctgcaggaggtctttggagtgggggttctgggtcacaccatcctggtgttcacccggaaggaagacctggctggcggctccctggaagactatgtgcgagagaccaacaaccaggcccttgcctggctggatgtgacccttgcacggcgccattgcggcttcaacaacagggcacagggggaggagcaggaggcccaactgcgagagctcatggagaaagttgaagccattatgtgggaaaacgaaggagattattacagcaacaaggcttaccaatatacccagcaaaactttcggctgaaagaactacaggaaaggcaagtaagccagggccaaggctctgaggacgtgcctggtgaggagtcttggctggaaggactgtcccagatccagaaggaatctgaggaagcccacagatgcctgctggggaaggctgacctttgagcctgtgctggacttgagccaaggacaccatcagcctttgcac

SEQ ID NO: 12967 - DNA, 7531 bp, Homo sapiens
aaaaaggccgcgctgtactgcggcttgtgccgcttccgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctctactaaaaatataaaaaattagccaggcatagtggcgcatgcctgttgtagccccagctactcaagaggctgaggcaggagaattgcttgaacgcgggaggtggaggatacaatgaacccgaggtcgcgccactgcacttcagcctgggtgacagagctagactccatctcaaaaaaaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagtacaaaagcatataagtaactaataaaagctccctttctgcattaggcccctcagttcttcccagggaaaatgattaatagtttacattcttgcagaaattttttatgtataaatttttacccaaatgaattcattatataaattttttccaacttagtgtttttttacataatagtagcaagttaaaaaattgtacttcaggccaggcacggtgggtcacgcctgttaatctcagcactttgggaggctgaggcaggaagaccacttgaggtcaggagttcaagaccagcctggccaacatggtgaaaacccatctctactaaaatacaaaaatcagctgggcatggtggcgcatgtctgtaatcccagctactcgggaggctgaggcaggagaatcgcttgaacccgggaggcggaggttgcagtgagctgagattgcgccattgcactccagcctggaggacaagagggagacttcctctcaaaaaacaaaatattgtacttcaaaaaattattcttcaatgctatttttaaattactagaaattattttggaatttaatgttgcatacagcctgagatatggctgttcaccctttggtaaagtattaaagaaaaataatgcattgttctcagcttaaatttttttctgatttgacaacatgagtgatgttttcccagtattatttcaattatatttgttttattttctgttcctcactcctacctctcattccagtccccaaactggcttttcttttatttcttttttcttcattgctgatgtatttattgagcaatgtcctgtatcaggcactgtccaaggtgctgtatgtgccatgttgaagagaacagacaggacctactgtccttgtatatcttgcctttgataacagaaactgcaggggattggaatagcctctttacaagaaaagaataagagtgaggaaaagcgtttggaatttatagtgatcacagtgaccaggttttgtattgggtatgttttacatttgtaacttcagtgctatttttttttaagctccattgttttctaaatgtaaacaagtatcaatgtaaggacagtttcatcaggtgaatatcagaagtactgacaccataatctcattttgcactgtggcaaagggtagtagatgtgtgttcaggattatttgctctgtcagtagtgcccagggtgccactccatgactaaccgaaacattttattatgtgactcactaagatgttcaattcattagtattttctggttactcaaagtgtactctatgtacctttttttgacctttgatttttattctgatggagaagatcagattccttttttatcttataaaaaataattttgaaacaaagacttattttgaagtaagtcttttaacattatctcagatgcattttattttgtccttaagtaagacttttcatttttacctttcaaaatgcaattttcaaaatatatgcttttttgaaacacttattatgttactgaataaccagagtattaaattcaatgtacagcaaatttttacaaagtcccagtagttcttgcagagctttctataatatcagatttatttaccatcatgaaatatgtttatacagtattaagtatattgtactatgaagttggacctgcacactgaaaaattccaaaatacctattatgttgtgctttttgtgatatatattcatattattatttgtcataacaaggtgaacttttttaaaatggtaaacatgtattagttacataatcaggaaaaaagtcatcttttataatgagaaaaattaggtcaaggatatttcaggttttatccaattagatttcttgtaaagttatgtgttttcttttatctcagtgcttatttgctttgcaaggatgaaggttagagattcctttcagtagttaatgaaagctacagacttgtcttgccgaaaaatgtacataaacacataaactattttccaagcagtttcacagtgtttgcaaagttcagattgaaaacccagttttacaaatcccatctacaaatttgcattgtcattaagatatattaaaaataatttttcaaagcaacagcacagatgcactttaaaactgtagcttaaaaataaaaattagtaatataacttgtgtaaacctacacaaaagataaaagatatcttattgcaaaaatagggcaacattttgttttaaagaccaaatagtgaattgaatttaatgcatatctttaaatccttaatagtatctcaaatctggtttaaatctgtctctccttaacggaatagaaagtgaaacaaatccagaaatcttgttcgagtacatggtctgtgctagtaatcatatctaaagtggtaatgttaccatatgctgggtactgggctgagtaaatcacatattttaacttatttaaacactgcactgtattgcctgctagcgatgtcatttttttaaagttggatggtgaatacatgagttgttttttaaactcttttgggagcctaaaaaatttgaatttttttttttccccccccagacggagtctcgctctcttgccaggctggagtgcagtgacattatcttggctcactgcagcctctgattccctggttcaagcaattctcctgcctcagcctcccgagtagctgggattacaggcatccaccaccacgtccagctaatttttgtatttttagtagagacggggtttcaccatgttggccaggatgggaaaattttttaaaagacatttattaaaaaaaaatgtctatgccttatcaaagtttataactcaagaattaatgagataaacagtggacaaaaagtgttggcagataacatgcataattttaattaaaagttaagcagtgaaaaataaacatctttttttcttaaagagatatttcatatctgttctatttgtttagttttatttattctttttagagacagggtctctctgtggagtgcagtggcatgattatagccctctgcggcctcaatcttcagggcttaagttatcctcctgcctcatcctcccaagtagctaggactacaagtgtgtgccaccatacctggctaatttttaaaaactattttgtagagacagggtcttactatgttgcccagagtggtcttgaactcccatcctcatggaatcctcccacttcagtctctgaaagtgctaggattataggcatgagccatttatgcccagccagttttcttttttctaattgaagcttggcaagcagagggaaatgtattagggaaatagctttagttttgagtgggtgtcagtagccagctgaagaaaaagcaaaatgaaataggtagtagaaatgagaaagggagagagggaagaagaaaaaaatggatgttggaaagttgttgcatgtctctctggatagctcagaagtatcagttgtggttattgcctcacttggcttttgtaagcatgaaaaagccagggacaatttcaactaccatttctgaccatcatcaaccacaaattttaggcaatttgttagaattttttttaaatgttcttaatagttgttgggtacctgggagatttcagagaaagtaatcacctttgtatatattattaatgtgtttataatagaaattaaattctttgggatgtacaggtaagataagctatgtgaagcatagctgttatccaagtcgtgtgcctttgaaatacttggaatttgaagaacaggacatgcagcttatgttataattaatttgcgagcaatatatggcatgatagtattttcttatctaaattctgagtgcattgaaagtttaaagcaaaggacaaaagcttcctttgttcatggcccatattccagtatatttttctgaaactgccaatattttctgatcggtactttcatttttctagttggttaccaaatactgttattggtattatttctatataaaaggctttaagaagactatagtataattttcttaagaaaaaagacatgattataagctaaaatatgccttcggttttgtgtgctacaaattgagggagattgagaatattttaaatcaagggcagacattgagtaaaagcttatgactttggatggatttgaaacatgattaaatgacagagtaaataaaagcccctagtcaagtgaattctaatgggggaaataagaggactatataaaaattgaacctctgttttgaaaacaaatctttccaggaagtggtaccactctggggtcaagagaaattgtaagaacaataaaatgagcacacatgaccttcctttcctataaaaatatgaagcagaaaactcccccatgatttcctcatgttgcttagaatagtgtgtatttcagaacttttccatttaatatttttggaccacagttgactgaaactgaggatgggaggaagggatgcttaaaaccttggatagtaccaaaccctatatatattatgtttttttctatatatacacagctatgataaagttcataaattaggcacagtaagagattaaaaatattaaattgggccaattaatatattgtaataaaagctatgttaatgtggtc

SEQ ID NO: 12968 - DNA, 1740 bp, Homo sapiens
ggggatgacgtaaaaaggccgcgctgtactgcggcttgtgccgcttccgcaagaaggtttcctggcctgttgcagccatggtgcattgcagttgcgtgttgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccataccttttaaagttattattttgtaattaagtatgtcaacagtaaaaaataaccagtggccaggcatggtggctcatgcctgtaatcccagcacttttcggaggccgaggagggcagatcacttgaggtcaggagttcaagaccagcctggccaacatggcgaaaccccgtctct

SEQ ID NO: 12969 - DNA, 1057 bp, Homo sapiens
ccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgggcttggccagtcggcagtg

SEQ ID NO: 12970 - DNA, 1301 bp, Homo sapiens
acaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggtgcgcccacctgaagttccccatgggtctccaggaagtgaccttggatgggggtgggaaggggctgctggagccaccttgctacctggggagggtcccttcctgaccccctgggtgggctggactgtgctggttcatttagaaatcaaagtcctttgcctggcgcagtggctgccaggagcagtggctcaggtctataatcccagcactgtggaaggccgaggtgggcagattgcttgagcctaggagttcaagaccagcctgggctacagagcaagacctcatctttcctaaaaaaaaaaaatacaaaaaactagctgggcgtggtggcgtgtgcctgtactcccagctacttgggaggctgaggtaggaggattgcttgggccccaggggcagaggttgcagtgagcccagatcgaaccactgcactccagcctgggtaacagagccagaccctgtctcaagaaaaaagaaagaaagaaagaaagaaagaaaatttaaaaaaaaaatggaaatcaggctgggcgtggtggctcacacctgtgatcccggcacttcggaaggccaaggcgggtggatcacttgagcccaggagtttgagcctagcctggccaacatggcagaatcccatctctactaaaaatacaaaagttagccaggcgt

SEQ ID NO: 12971 - DNA, 1599 bp, Homo sapiens
gtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaa

SEQ ID NO: 12972 - DNA, 5340 bp, Homo sapiens
cggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaattttttttttttggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 12973 - DNA, 1771 bp, Homo sapiens
agcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaatgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaacagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttac

SEQ ID NO: 12974 - DNA, 1491 bp, Homo sapiens
gtagggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaacagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaa

SEQ ID NO: 12975 - DNA, 694 bp, Homo sapiens
cagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagactgtcactctgtcacccaggctggagtgcaatggcgcgatctcagctcactgaaacctccacctcctgtgttcaagagattctcctgcctcagcctcccgagtagctgggattacagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacag

SEQ ID NO: 12976 - DNA, 990 bp, Homo sapiens
gaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 12977 - DNA, 2019 bp, Homo sapiens
gcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 12978 - DNA, 1532 bp, Homo sapiens
attctcccgcctcagtctcctgagtagccgggactacaggcacccgctacaacgcccggctaattttttttgtatttccccttccttctttgctttcaaaatccaggcttaggggtacaaaaacctatattgtctgagacaggaagcactccgaagtttgaagaagagggcagcagcccaactcagaagaactggactccccagcactataaggagagagggtggtggttccaccagagatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatct

SEQ ID NO: 12979 - DNA, 5393 bp, Homo sapiens
gagggccggccggtttggcggcggctgcggagggtatctgaggctcggctgccaagccgaacgggctctggctcctcccagtggccggccggggcggaagcaggaggcgggggcagcgtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagcagctacatcacatctgagttctccacagcaaaaatctacggcttaagagctgagttggggataaccaaaagggactgaagagtttgtacgggtaaataatcaaagcaccattgcctacactcagacagattgatactgcttttgcctttgcctcacttattctttatgtataaattcactgttgatgtctctgtgaatatgtatgaaggtgggtgaatttgggggtaattatgggcttctgtctccttaccagtttctaagaactgttagaaacgcccattatttaccagtgttacttactacttatatatactttttggagaatcagttttcttataagtaatcttatttctccaaagggtgaaaaagagatgaacatatcagataaaggtataggtgggctattccagccacttttgaaggacactgagggtataaaatgtaagctaccataagatggaaaagcaccaggaatttgttgatgtacttttgaattttatttcacagccttgggaggaagaaactatgagtggtctcagatgtctatgaatggtcttaaaatgttttcaaaccatgttccacatagatgccatgttattcaatgtcagcttgtttattagtaaggagctttatcctcctagccttatattaccagccccccacagccttgcatagaaagtttctgttatctccttagaagaaactggctcaatgacgtttctggtgtagtgcagatagaggtcaagaggagcattttcatctcttcttttgctggtcagagaaacggttctgagatcacagaagctatgatgcatacctacagcttacaaaagggagaggaaaaatgtttatatcatctagtaaacagttgtaaaatgagcttttaaatctaatctatagacatattattcattgctcagacacctgtgaacagtcttgatacatgcaagatgtttgccaaactttgtaatcctttctactagctataagagaggatttaagaactggtgtaggacttgttgccatcaccaccagtttctaacagatcttttataacattcacataagtactgtagacagtagtagacttaaactctccgtttctctcagtattttagctaagaatgttaccatatttttctcttaacaattccatctcaggttgctgctgcttgtctagtttaaaaggtcagatctattaatcaggaatgaaattttatttgggattcagtgttagacaaacaacaaaatgatgcgtggcagaagtcatctttttattctggctggtccagggaacaagaaaactgctgctggaccagcaagggaagagtttctgtctgtcttaacagaaatctgtccccaagacaaaggggtacttgactcctacaaaacttaaagggtacattctctatctgatgaggaggtactcattatggccttctggaaagaggctatgttagtgatctggtctttacagatttagagtcatgttatttgaaagctagaatagacaacctataaaatgcttaccaacatgtgtcagtacacgtttatgtttatatgaaaaaaaatttctagccacagtgtcttatgattttgtattgaagcaaacagtaggaattttggaaaaatagagagtaagaatgtgtgttctatggaacactgctccactgagaaggtccatgtaaaaaggattaggtggtcatataagtttggggaacataagctcacttgtcctttcctggagattcatggtatataatattcaaagctctgagaaattctgaagttaaaaacaattgttaaattctgcttaaattagtgttttcctgatatttgttttttgaacaccttttatataatcccttctaatatatacttagtatatacttaatataatattgggaaaattgttactccaaagcacatcttgacatgacatagtttcttaaaaatccaaattttctggaactcagaaatttcctaatatttagcacactgtcttcttttgcacagcactttttgctttgtgccatatagcattactctgtaccttcacagtatttcatctgagccactgaggaaagttaaaggttgcacttccattttacagttaagaaaacaagctcaccttaggcatggttacttaattaatttcagaattaaatttcaggtttccttagtccagattgtcctgatgtgtattctgacacctaaaattatataaacatttatgggatgcttattttactaagactagaatggtggctacctggctaataacattcatcattggttattctgggcatatcatgactttattcccgttgcttaccatctacctgggacacatctctctttgattaaatatattctttttctttgtactttttaggtagacagagaatgtagatcattgaaagcattatttattcctaagattggcaggcacagaatcatttttaagaaccaaatacccagtcctgccttaaaggccacatctatgatcatcagctctgttagaaataacagcctggcataattcctaaatacaagtctgtagatatatccaggagatagggttacactgttttctaaccttttttaaatcccttaatcttgaggtaaactgcatgcatttagtcaaacaagcatcataaaatttgtttcctcactgtttgggcttaacctcctgatagcctgttttactgaataacttgaccctaacctgtagagaataagagcattcaaattaggaaggcaggactatccatctttagtgcttttcctgccgttaaacaacaatgtgaacttggtcaagtcatttctgttctttatctgtgacatgaggtaactgtattaaattttcagcatcaaa

SEQ ID NO: 12980 - DNA, 2199 bp, Homo sapiens
gtgcgcgctgctggtcttctctcccgcggcgctggggcccgcgctccgctgctgttgctccattcggcgcttttctggcggctggctcctctccgctgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctatt

SEQ ID NO: 12981 - DNA, 2229 bp, Homo sapiens
tccattcggcgcttttctggcggctggctcctctccgctgccggctgctcctcgaccaggcctccttctcaacctcagcccgcggcgccgacccttccggcaccctcccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttcttgttctattaaagtaccgtgtgcagttt

SEQ ID NO: 12982 - DNA, 4378 bp, Homo sapiens
ggcgacgagtgcgggcctcggagcgactgcagcggcggcggcggacgcggcctgaggcgagcggcggggcgtggggcggtgcctcggcccgggctcgccctcgccggcgggagcgtccatggcccccgggcgccggcggggcgcggccgcggcctgaggggccatgtccggggtggtgcggaccctcagccgctgcctgctgccggccgaggccggcggggcccgcgagcgcagggcgggcagcggcgcgcgcgacgcggagcgcgaggcccggaggcgtagccgcgacatcgacgcgctgctggcccgcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctcaaaataagatctgttcctcatagctatactgtgtacacataagacgcatatagggttttactgaaatctatttttaactcttatgttcgtagagaaattgtttcaaggattttgagtcataggtctgtaatttatagagatctctagaattcttattgtaattttcctacttctttgataaaagaaaaataagtcagattgttaactccaagattgaaaaaaaaaactcttgaaagaagattattagttgtaactaatttaggggttctgggcacagacatctaacctggtattgtaaggcagaggctcccattggaatggtagtggtccgggtcagttgttcatggtgtaagctttgcacagtgtattaacattgggagggtctggcttgaaaatttggccaccctcagcctctgaatgtttattaaaataaatttagtctttctttgcttaa

SEQ ID NO: 12983 - DNA, 3785 bp, Homo sapiens
aatgcttctgagaagagagaggaagatgacttcagaggctgcttgtggtctctcactcaaggctggtagggagccccggtctgcgtcctggaggaacggcacgctgagtcctgggccagtggccggcggggctgttggcgaccacagtagcacacaagggctctttctgaggagcaggagaccctggcacgggccccacgggagtgtctggggcgtccccgcctgtggcctcttctccccgccgcagcaccaatggctccacgagcagggctcggagctggccctctcctgcttcggagccgcgctgactgggtgtgtggcggatgggaggccgccctgagtgctcctcctcccttttgtacagcctgggtggaaaggacgggcctggtgcacttcctgcgggagggaggacatggggcctgcttccctctggcgctcctccacccgggcagcgtggtttctttccaaatgatttatcctctcatcgtcctgccgctctgtgcttcatggcattggggtcttatccggaaggggattgtccttttttggggggagtcggtgaagtacttcctggacaacttggaccggatcggccagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatgcccacggtgactgccgctccgtccgtgcacacacagcggtgctcttctccccttagccacccactgcccaacccaacggcaaagacacagaaaccaggtccccttgcagacggctctcccatcttcctgcaagtcatctgctcacacacagttggcagcacatagcgtttccttctttcagaaacattcctcttctggggcttcagaaagctggcaaggccactagcagagcttttgttaatgccccagctgcttggcgagctaacagctgacctttcgggaagcccacagacgctggaggaatcttgagtttctccaaactgccgctccaccagtgcctttggacagccgtgcctgttcgccgctctccctaagtctgattctcatcgaggcccctcgcttctatgactgtgcttgcagaagagtaaacactctcggatgccgctgtcctgggggagcccgcgggagcctgtgaatgttgatacgagctggccagtcctgggcccagctcacttgtccagctacctgccaggtggctttcactgtgtttaaaatacattgcattccaagctggtcccctctgtgtatcactctactgagaaatcctgcctagtgtgttttgggatgtgtcctagcatttacaagaaaatgaaaagcgtcctcttaattggcacccgaatgttgctgtggctcagtcacatatcccagggccctcgtcccgaggccgtgctgccccgagccccgagcccctctgcagctcacccttggcttgttttccgcaaacccggtaaacgcaagcccttggggcagatgcagaagcagaagagggaggggaaacctgcctctgggtcaccctgttagcacagcgttctcatcgggagacagcatggaactctctctcgcagtgctcgaggctgtgtgtcagtgtttgctgggcttgtggctccttttttggctggataaagaagtcgctgtttttgtactgcttctgtggctcttcacagacctcacggatgtgaccggagatgagtgccgatgaccacgttttaaaggagaaagagagctcctggtggggccctcggggtggtctcaggtcccatttgcagtctgcaacagtgacgcgcagcccggtccggagcgtggtgagctttgtttgccttctgggtcagctttcgctgtgtctcctgtgtgtgttagaatccagagcccagaggaagtgcaagcgggtcctccgccaacggggagagcctcttcgcggcgctgttggcgacagcagcgctgtgattcgcgtagcaggggagttgtttgaaacaccttcctgagtagtccggccttgtcaatgagtgcttgttttcctttaaacagtctgacatatttactcgtcactttcaaaccagaagcatgagaggaaggagatattgtggggtccgtttaactcgatagaaagcgcagggggatggcccccggcgcgggctcttgacccgctcagcgctgaccccaccgccctggccgaggcacttggccttgctgagctggacttcctcctcctcctcctcatgaccggggtgaattagaacgtttttaaagacacccccttccaaattctgtaacacattgtaattggagaagaaggaaactctgcaaggctaaactgtcattcacaacttggctacacatagactctagtcagttttgtctccagaaccttaggcttttgtattttttaattttaatttcactgttaatccttattgtcttttttattaagatgttggaaaagcaggaggtagttgtgcctcaattattgcaaaaatgtaacaataaagttcctc

SEQ ID NO: 12984 - DNA, 1317 bp, Homo sapiens
gcgagcggcgcgcggtccggcgcctggtgaagatcctgctgctgggcgcgggcgagagcggcaagtccacgttcctcaagcagatgcgcatcatccacggccgcgagttcgaccagaaggcgctgctggagttccgcgacaccatcttcgacaacatcctcaagggctcaagggttcttgttgatgcacgagataagcttggcattccttggcagtattctgaaaatgagaagcatgggatgttcctgatggccttcgagaacaaggcggggctgcctgtggagccggccaccttccagctgtacgtcccggccctgagcgcactctggagggattctggcatcagggaggctttcagccggagaagcgagtttcagctgaattactttcctagtaagcaagatatcctgctggctaggaaagccaccaagggaattgtggagcatgacttcgttattaagaagatcccctttaagatggtggatgtgggcggccagcggtcccagcgccagaagtggttccagtgcttcgacgggatcacgtccatcctgttcatggtctcctccagcgagtacgaccaggtcctcatggaggacaggcgcaccaaccggctggtggagtccatgaacatcttcgagaccatcgtcaacaacaagctcttcttcaacgtctccatcattctcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtcttt

SEQ ID NO: 12985 - DNA, 1597 bp, Homo sapiens
gctgcggcggcggcgcgggctgagtgcggccgcgcgggagtccgcggctggcgcggcccgagcggggacccggcggctcgccaggcggcggccgaggcggggcgggccggcccggggccgagggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccggatggtggatgtggggggccagcggtcggagcggaggaagtggatccactgctttgagaacgtgacatccatcatgtttctcgtcgccctcagcgaatacgaccaagtcctggtggagtcggacaacgagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttct

SEQ ID NO: 12986 - DNA, 1416 bp, Homo sapiens
ctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccacctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcgg

SEQ ID NO: 12987 - DNA, 6311 bp, Homo sapiens
ctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaatctagactatattttgaggcaatgaattacttatattcaacttaggcttgttttgacattcagtagaactttaagttcaatctaaaggcttcagtccacatttttttatacgttgtattttaaaaacgtttgaaaggagtcttacacctgtatcatgaaaactgaatccttttgaaataccactatatgaagagagagatgaaatttagtgaacagaattgaaaaggtgctcataatttcactatgcaaacttaccccagtctctaaaaaagtaatttagatttaaagttctttgatgtatttgattttctaaatctttatggttatgatttggaataaaatgtgcctaatcctgtgttacattctgttcttaaatctgaatgccttctcatttaattctgaggaaatatcacacaagtgtcttcattgaccttgaagaaatgtatatacagttgccttataaaacaacataaatttagaccataacttttatagagaaagggttttgtcaaatgttttctgaaaatctgagtaattcaaagcatgcctctgcccctttaatatttttaataacctgcattgttgctgtctgccaaatattaaattgaaatcttcatttcaattttattatctggaaagggcactggattgctctgcaaccaaagaaagcaatatggaatgaaaaaactcattcacttttgtcttattttcttttaaggtgtattggcatgtaatttgcatagagaaggtcctctggttagtctctcaaattgaggctgtttagggaaatccttattcagttggtggcagtggttggtttaaagtagaaggaaataagatcgccttaataccagaaatgattagaagtgctgatttagattcaacaaataccatatgtccttatcattttttgtaagaagaaattggttaagtcctaactttcaatgtgtacccaaatacttgtatttatgcttttgataaaatgtattttcagcattaatacacatccgattatgccttatttatatatgaagaataaagttaccatgttacactgttatgtcctaaaattcaaatcactatttgagaaaccctcaaattggtgctttcattatataatgatacatttagacaaaaccccaaactaagccatttgaaacaagattctctccattgcagtttgtagcaatgttatttctgtgtatgtcatgagaaggctaaatatcagtgttaatttcttgtttgaatccgtgaaatcatgcctgtaaagcccaaacatttgtaacaaactccctaataaatttagagaaagtcactctgttaccatttcatttattttagttttatttgagaaattaagaccagaagttttgctcatgtctttttcacttggaaatctgacttagtacctagttaatttgtctctctcccatcattttaaggcgttcgcttctgttaatcacagatgatctgtccttgtgttgtgctgcttgactaaaagcactgttttgttttgttttgttttgttttttaatgataggatacagggtggcttttcagtctagtaaacatgaggaggggagagattgtgggtgggtgtgggtgtgtccgcatgtcccaaatacagcacatgcccatttttttatggtacgaggttagggcttattaataaatgtatactagatcttgaagtgtaagtctaagtctgaacattttaaacaagttggactttatggctttttcaagttccatcaagtagatactagtcttaggctggtaggtgattaacaacatcatttggagtacagtgtttgtaccactagcattcttatgtctgtacttgaacgtgtagttagcatttaagttatgttcactcttgtagcattcaggtcttaccatctggtttcaaatgcgagagcttatatgaacattgttttgaaagcatgaatgatatggcaatattttatgtcttgataaggagagttttgtgacatatacaaatctgctgttgatgatgaaagtttacaggtggatcagagtatgctggaactcagtgtgcataaaatttcagtcagtgaatatcactgaacgtcatatactacttggtatgtgactttggtttgtgttaagaaagcttgtatataatattttttgccatagtaagtgagaaattgtccttaatcatgcctgtttgatggtactaggaaagaaaggggtagagattaattcttgcacagtataagcaacagtgcaacaaactatgccatttaccttttacctcttacttgaaggcagaatcgcaaaacgtttgaaatggcttttctaaactactctactctggtgagagctcatttaccacaagaagccttataaaaaagtatattttgtaataaccccgtagatactgtacctaacaaaacatgactcgtattagctctataaaatatttgtggcttaggattttttttttacatatatctttttataactttccaggaactaagcacattatctgataattgttgtaaatttttttgtcagtgctttagttcaggatgggcaataaattatttctaaaggaggtctaaaagtggaaagaatggtttgattttataaaatgagttgctagttcattacagctttttacttttgtacatattttgcaaaacatttgcctcttgctattaatatttgctttgtaaaaattactgacatttaataaacatttgtaaacaattcaa

SEQ ID NO: 12988 - DNA, 1502 bp, Homo sapiens
aataagggaactttttgcccgagacttcttgtcaagggcgtagggtgacagcctccttttgggcgagaatatgaaacttgaggagtgtcaggttgactgtactggaatcaggagagagtggacccatacagttagcatgaaaatgtagcatctgtgctttttcgccccagtgtcacggtcaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactgggtgaatctgtaaaatatttcctggataacttggataaacttggagaaccagattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaa

SEQ ID NO: 12989 - DNA, 2482 bp, Homo sapiens
ctgcggtcactgctgaggttttcagaactttccaggcaaaggccagccaggtcctttgcctccaacccactccgcgcctacctcccgcctggggacacccctaggcccaggagatcctactctcccccgagcaccgacgttccaactcgtctgcgcccccgactgctgtccggctcctgtgccaaggggcgcgcgcatcttcccggggccagcaacgctcccaacttctcgactcgccctcctcctccccagagcgagagtggggcgggctgagcccggatccggggtgcactcgagcgttcccagcgctcggcattcaccccgcctcagagccgactttcgaagggggattgagcctcggaggtccaggcgtcttactccaaagctcaagtcggcccccgtcttttctttccacacccctgtgcccgtcgcatgctggccgggtgagcggccgggccgaggattcgggtgcccggggccgcgtcgccccgtcgggtactgagctgagcgcaccatggccggctgctgctgcctgtccgcggaggagaaggagtcgcagcgcatcagcgcggagatcgagcgacagcttcgtcgggacaagaaggacgcgcgccgtgagcttaagctgctgctgctgggaactggtgaaagtgggaaaagcacctttatcaagcagatgagaattatccatgggtctggttacagcgacgaagacagaaaggggttcacgaagctggtttaccaaaacatattcaccgccatgcaagccatgatcagagcgatggacacgctaaggatacagtatgtgtgtgaacagaataaggaaaatgcccagataatcagagaagtggaagtggacaaggtctccatgctctccagggagcaggtggaggccatcaagcagctctggcaagatccaggcatccaggagtgttacgacaggaggagggagtaccagctgtcggactctgccaaatattacctgactgacattgaccgcatcgccacaccatcattcgtgcctacccaacaagatgtgcttcgcgtccgagtgcccaccaccggcatcattgagtatccatttgacttggaaaacatcatctttcggatggtggatgttggtggccaacgatcggaaagacggaagtggattcactgctttgagagtgtcacctccattattttcttggttgctctgagtgaatatgaccaggtcctggctgagtgtgacaacgagaatcgcatggaagagagcaaagccttatttaaaaccatcatcacctacccctggtttctgaattcgtctgtgattttattcttgaacaagaaggatcttttggaagagaaaatcatgtactctcatctaattagctatttcccagaatacacaggaccgaaacaggatgtcagagctgccagagactttatcctgaagctttaccaagatcagaatcctgacaaagagaaagtcatctactctcacttcacatgtgctacagatacagacaatattcgctttgtgtttgctgctgtcaaagacacaattctacagctaaacctaagggaattcaaccttgtctaaaagctgctgcccactcctcccctataacagaagatgtgatttgcaaactccttgttttatttgcaagtgcttctgacatcaccagagccagccccatgccaggaactaaggatgtcatgtagatcgtggggacagagatgggtgatggaacttggaagatatttgagtttaccaacatactttaaaagtccttacatcccaaattgtgtttataattattttcttgacttttggctataagattttgtgtaatttttgaatttggtgttttctagaatttttaaaagccactttgatttagttttaaatatgtttaaaaatagcgattaaaattatgtaagcaaggagcctgttagtttatagatcatgccttcaaacctctagagttaatttgggtgacttttttaaaaataagaatgttaatgggtttgaagctttttattaaaccttgtaatttagagacatttttaattgtgtttctcacctcatgctgaagggtgactcctttaacatgccaccaaagattttttttaaacacttggttctttttgtgtgttaactttctaagccaaattaatggatatataagtatatctaatttagctttgccacagtttgatcaccaagaagccaaagctgacatagagtaaatgggctctagatagcatatatgttttattggtgaaaaatgtgtgtgtgtgcacgtgtgtgtgtgtgtacatttttacccccaatgtatatgaccagatcttaaaaatgtatgaaatggctagaagtccacattgtttgacaaatgttacgtaaccctgccaaagttctgatggccaccacagatttgctgtttgaattatgtatgctgtgcctttctgaggaggctaagaatataccattctgctatta

SEQ ID NO: 12990 - DNA, 2132 bp, Homo sapiens
ggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctactatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgcctcttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggacccctagtgtccctggtctatctctccagcctcggcccacacgcaagggagtcgggggacggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgaggacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctgcagggctccgtgcgggctgaaattaaagatttcttagaggctgcgtcgccagcgtcctgttt

SEQ ID NO: 12991 - DNA, 3279 bp, Homo sapiens
actcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttgactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctg

SEQ ID NO: 12992 - DNA, 1299 bp, Homo sapiens
atgggatgtactctgagcgcagaggagagagccgccctcgagcggagcaaggcgattgagaaaaacctcaaagaggatggcatcagcgccgccaaagacgtgaaattactcctgctcggggctggagaatcaggaaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatactacctggacagcctggatcggattggggccgccgactaccagcccaccgagcaggacatcctccgaaccagggtcaaaaccactggcatcgtagaaacccacttcacattcaagaacctccacttcaggctgtttgacgtcggaggccagcgatctgaacgcaagaagtggatccattgcttcgaggacgtcacggccatcattttctgtgtcgcgctcagcggctatgaccaggtgctccacgaagacgaaaccacgaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactcca

SEQ ID NO: 12993 - DNA, 3402 bp, Homo sapiens
tcttcgcccgccaggagcagggacgcgtccgagccaacacggggcgcgcgcccagacgcactttcccggctcggggtgcaagagagccaggcggccgcggcgcagcggaggggctgcgggcccggaacccaggccggtcagcgtcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagggaaccagggatttttttctctctctctagacaatatgtttcctcattagtctgctaatgaaacacttcttcaagttccccaagtgggaacaggtccatcattcccttagtcaaaactttggacacaggctacgtcatacaagtaagcaaacagtaagagaaaaacaaaatgtggccaggcgcggtggctcacgcctgtaatcccagcactttgggaggccgaggcaggcggatcacgaggccaggagatcaagaccatcctggctaacatggcgaaaccctgtctctaccaaaaatacaaaaattagccaggcgtggtggcgggcacctgtaatctcagctactcgagaggctgaggcaggagaatctcttgaacctgggaggtggagattgcagtgagccgaggtcgtgccatcgcactccagcctggacatcaaagtgagactcaggccaaaaaaaaaaaaaaaaaaaaccttgacgtgtcaatgtttgtgtctggcctaggagaatgaggatgacagcttcacttgccttttgaagaagaaacattacaaaaccttaatctgaagtataaagtcaaaagatacggctctttctcacacttgcaagacttacaaatacagcctcaaacattatgacacaccaacaatatctagaaagtaagaactggtgtagcaatgatgcttcatattctagctgtagccacagagttgagggtagtttttgtaggtctaaaataataatctataaagatgtccaaagttaaattttcaacaatacaaatctagagaagtgacagcctacattacttcattattactcttcttttagtctttagtctttaatattttaaagtttactctataaatcagcattttgtaatcctttataaactcatccagatttaaatgct

SEQ ID NO: 12994 - DNA, 6225 bp, Homo sapiens
cggttcggtccgctctgggcgttagcaagtgatctccagccaaggcggccgccaccccttgcacacagcagaaaatgcaaaatgaccctctggggcagtgaggggctgtggccctcggccccggcctgccgcacccccttcccgcagctggcggccggcagcgccgaacagggtccgggtgcagccccctcccgcccctccgctgaggcgccggcctgaactgggcgcgggaaccaggccgccctcggcgcccagcctgccctagtcccgcgcgccgcccccgctgtgccgcgcccacatgggtctgtgctacagtctgcggccgctgcttttcgggggcccaggggacgacccctgcgcggcctcggagccgccggtggaggacgcgcagcccgccccggccccggccctggccccagtccgggcggccgcaagggacacggcccggaccctgctccctcggggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagggaaccagggatttttttctctctctctagacaatatgtttcctcattagtctgctaatgaaacacttcttcaagttccccaagtgggaacaggtccatcattcccttagtcaaaactttggacacaggctacgtcatacaagtaagcaaacagtaagagaaaaacaaaatgtggccaggcgcggtggctcacgcctgtaatcccagcactttgggaggccgaggcaggcggatcacgaggccaggagatcaagaccatcctggctaacatggcgaaaccctgtctctaccaaaaatacaaaaattagccaggcgtggtggcgggcacctgtaatctcagctactcgagaggctgaggcaggagaatctcttgaacctgggaggtggagattgcagtgagccgaggtcgtgccatcgcactccagcctggacatcaaagtgagactcaggccaaaaaaaaaaaaaaaaaaaaccttgacgtgtcaatgtttgtgtctggcctaggagaatgaggatgacagcttcacttgccttttgaagaagaaacattacaaaaccttaatctgaagtataaagtcaaaagatacggctctttctcacacttgcaagacttacaaatacagcctcaaacattatgacacaccaacaatatctagaaagtaagaactggtgtagcaatgatgcttcatattctagctgtagccacagagttgagggtagtttttgtaggtctaaaataataatctataaagatgtccaaagttaaattttcaacaatacaaatctagagaagtgacagcctacattacttcattattactcttcttttagtctttagtctttaatattttaaagtttactctataaatcagcattttgtaatcctttataaactcatccagatttaaatgctactttttcatgaagaaaggataactttatagacagtcagtgcaacacacacattttatctcatcaccgtcttactgcctccccatccactgtctcataaagccctcagctgaactaagataaataatacaatggaaattattttcagttccccttgcactgtcaaagtaaaacaagaaaactgaaaagctgcacccccagcaagaaagggaagtatgctgttgtatgcatcattactcaacaattaccctctaactaaacatcctgtttaagagtttaattcaaacaacagccagactgttaagaaaaaaaacaaaaagaataacttttatctggcttacaattattaaagcatttattttcaggtaccaaaagccatatcccattccactttttaagtttcttttgatcactgacaggcattaacagatgtagcaacgtggtctcctatagagaaaattacacttatctaaaaatctgattccattaattgatcaagtataaaaatctacgaaaacaatatgttctgcacatcacatctgtacttttttttttttaaatatattttttgagacggagtctcactctgttgcccaggctggagtgcagtggcatgatcttggctcactgcaacctccgcctcccgggctcaagggattctcctgcctcagcctcagctggtattataggcacttgctaccatgcttggctaatttttgtatttctagcggagacgaggtttcaccatgttggccaggctggtcttgaactcctgacctcaagtgatccacccgcctcagcctcccaaagtgctgggattacaggtgtgagccactgtgcccggccacatctgtacttttaagggtacagctttacagtacataggaatttgagaaccacttcacaggaagagggaaacagcccaatatttatttatgtatacacataatcccaagtgtgtgctggggccaccaggcccttcctgggggaacaaggactgtcgtgcatgtgagtgacgacattaatagcatttacatactgtacagatgcaacctttgatgatacatatatttgataaaaatgagaaaacagatttgttgtagagtacctgtccacttttatagcatgagaacagtacaatcaactatttattttgcagttactcatttcagtgattgagaatttctgtgctgtgcagagagacggcctgtaattggtctcatcatccacttgattctaacatgatctctgcccaaagttccatttcttgggctttgatatttataatggcgcctgctcttcatcttgtcttacgctttccgagcaagttcaaaccagaaagaaaaggtgaggctagaagcccaaagtgagtgagtgtgaggaccacaaggaagcccaccactccacagtagatgatcaaaaccacatcctcacgtgggaggtagcacttggagagggtgtagtctgtgggcgtgatgctaccctggaaaggagaagggaaagttatgctgagagcaccaggcacacgttgaacaccgcagtcttagaaacagcagagggaagactgccttctcaggtccccctcaggtgaggcagggaacgggccctcctcacctgagaccaagggggcccagccttctccctgcacagctcacccccgaccagcccaggctccagcaggagagacaagtaaggcccaagtgtgcctgagtggaaaatgtctgggacactgacctgtcaaaactggcccctggctcactgggttcccatcaaatatagtgggggatccataacagagattcagagaggcaccgtggagttccagggtcatcggtcagcgaggaacaaggagggaaaggtgtcttcctgccccttgatgctcaactaagcatctgttccctagaaatacatgtgtccaggtcgtctccatgggcttttctttgcagatacttttatgtggaacaacagtggcaaatgttttcatttactttgaatttgaaaatgttagggtttcctccacctttttatgaagtaaaagaacctgtcgtaccagcatcatgagctggatgcaggagcccatggctgaaaggagttaaaacgcccagtggtcattaagtgaaacatcttttatcaacctgcaaaagctgcagcgttctctgccaggtcaaatgggcatgtttagaaaataagagaagatggctgagtatagctaatgaataaatggttgtttctttagaaaattaaacacacacagagtgtaagaggagaggatacggccctccctgaaggataaagtccacctggacggtgccctgccctcgcttctcacattaactgcccaggaatgtcatgctgattggttcccggaagggtgtttggcaaggggcagtgtatggagctacgtgtagaaggagagaaatttgtgtgtggcttttgtaaattttgaccgattgcagcaattaaatagttgattactgtgttgatttaaatacttatgaaagctttcagacaaaaataaactttcacgttaccatgatgaaa

SEQ ID NO: 12995 - DNA, 2087 bp, Homo sapiens
aaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttg

SEQ ID NO: 12996 - DNA, 1285 bp, Homo sapiens
agtctagaagctgagcagaacaaaggcggtgtgactgcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtga

SEQ ID NO: 12997 - DNA, 1038 bp, Homo sapiens
aaaagagactgaaggggagactggacagactgcaaagggctggaggccacattaaaagtgtggactttaccccatgggaaggaggaagcgcaggagtcatgagaaatgatggttcaggcagagattagagcataaagcagggaggtggggaaagccaagaggaacacgctcttggatgacgagtcaccatgaatcactgatcacctgggacatggttcagctgcacatgctgacgcagtgggtctgccagtgacgccgatatgctgcgagtctgggaaccccttttaaggagcagggaatcttaactctggctgtgcattacaactgcctggtactttgtcaccaccttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccg

SEQ ID NO: 12998 - DNA, 1491 bp, Homo sapiens
aagccagctgtatttacggtagcgagggctggaccggcggcggcatttacggtaacgggggccgggctcgcggaggcccgtcggttcggtccgctctgggcgttagcaagtgatctccagccaaggcggcgaagggagcccggcatgcgctcggcccaaagcagacaagccgaaggagaagcggcagcgcaccgagcagctgagtgccgaggagcgcgaggcggccaaggagcgcgaggcggtcaaggaggcgaggaaagtgagccggggcatcgaccgcatgctgcgcgaccagaagcgcgacctgcagcagacgcaccggctcctgctgctcggggctggtgagtctgggaaaagcactatcgtcaaacagatgaggatcctgcacgtcaatgggtttaatcccgaggaaaagaaacagaaaattctggacatccggaaaaatgttaaagatgctatcgtgacaattgtttcagcaatgagtactataatacctccagttccgctggccaaccctgaaaaccaatttcgatcagactacatcaagagcatagcccctatcactgactttgaatattcccaggaattctttgaccatgtgaaaaaactttgggacgatgaaggcgtgaaggcatgctttgagagatccaacgaataccagctgattgactgtgcacaatacttcctggaaagaatcgacagcgtcagcttggttgactacacacccacagaccaggacctcctcagatgcagagttctgacatctgggatttttgagacacgattccaagtggacaaagtaaacttccacatgtttgatgttggtggccagagggatgagaggagaaaatggatccagtgctttaacgatgtcacagctatcatttacgtcgcagcctgcagtagctacaacatggtgattcgagaagataacaacaccaacaggctgagagagtccctggatctttttgaaagcatctggaacaacaggtggttacggaccatttctatcatcttgttcttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcag

SEQ ID NO: 12999 - DNA, 3347 bp, Homo sapiens
ggaggggcgggcaggggcggggccgcggcggcgcgcggaggccgagctcggctgggcttggcgaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattt

SEQ ID NO: 13000 - DNA, 539 bp, Homo sapiens
gttacagctggaaggatggggagatagcaccatagatccactcctcattttatgggcaaagaagctaaggcctgtaaaaatggcatgcccaatggttacgaggaaatccttcaaaatgcgttcttgtgaaaaacgtgagagtgcaaggaaagagggagggataggaagaaggaaagagaagcaaaagttccctgtttctcacggccctgaaaccagccgacagggatttgcattttgaaaaaccttgcgtggctgccggcgctgggcatgctcaaacgcccagaactggcttttttcggcaactttggcagctctcccacccccacccgaaggggcaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacct

SEQ ID NO: 13001 - DNA, 1633 bp, Homo sapiens
gaaatcagtgcaccttttgtggggcctctgagatggggctgaagcgtctttcctgttaacttcctatggcgactccttaagtggtcaaggagcgctgattacattccccctgcgctgagaaaaggctgcgctggatgcttgatttttcttgctgtgggggcatggaagccacccaagtggggttgggaagctttgctttagtagtaggcaaggcagatactcgagtggtgaaaactgctgtgaaagagcgagagggtcacgccagacaacagggttctgtctccgctgccaccgtttctgatgaatgagatttgccaggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaat

SEQ ID NO: 13002 - DNA, 2016 bp, Homo sapiens
atggagtatgcagggcatcttcctgccagctctgcccagggcaccatattggcatgcaccagctgcacaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgt

SEQ ID NO: 13003 - DNA, 2464 bp, Homo sapiens
agtgccgggtcccggggtttggaaccacccctattgccttttctccgcgtggccccgcctgcagcccaggcccgagcctgggctgcgcctaacttcccccttcgctccgccctcgagccaatcaacagcctctaatctcctctggccccgcctgcaagcccgccccggcccagtcacaggcttggttcgcccaggccccacccccggcccgccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaata

SEQ ID NO: 13004 - DNA, 2407 bp, Homo sapiens
acacgttgcccagccgtgtggctgggatggtcggtacccatggccgtgcggtcgagccttgatgctccaggacagtcctggaaggcttcctggcagatccgtgggaagaaagccgacagaagggcgggaggcgggaggggaaaggtcccccgggatgggtagggcctcaacgctgggcatcggcgcaggtgtgtactgcagggagccagccagaccccccacggactgcctgaccttgggggaagcccggagtagaggaagaggccggacccccagacccgccattgactatgtccgccattgactatgtgttctgagagaaatttttttttttttttttgagactgagtctcactctttcgcccaggccggagtgcagtggcgcgatctcggctcactgcaagctccgcctcccgggttcacgccattctcctgcctcagcctcccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaagg

SEQ ID NO: 13005 - DNA, 1663 bp, Homo sapiens
tgtgagtgcggcagcggcagtgagtgggtgtcgacgcggcggaatgcccgtcgctgctgctgctgctgcccgacgggcctggggagggcacttccggtaccgctgcctcccagtgcccagccaggagtctctagacagcctctccccaggcgattgcagttactgtggtggccgaggaaatgcaagactggaccatagagctgggggaacgcagggcttctggctagttttgtgtcccgacaccagaagggtcccccatcccaccaggcctgctccttggagcccagctcaccttttgggctaaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtt

SEQ ID NO: 13006 - DNA, 1486 bp, Homo sapiens
agtagctctgactcctgtcccaggttatgctgagtcccagcagggaaccaccacagctctgaatcagcctgttagccgctgtccattgctcttcatctgctctttatctgaaaatcttcagaagctttccttcaaatgagatgaccacagcagtcttctctgcaggttgcaggaaatgagaggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcct

SEQ ID NO: 13007 - DNA, 2153 bp, Homo sapiens
agtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatgggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgt

SEQ ID NO: 13008 - DNA, 1086 bp, Homo sapiens
atgggctgcaccgtgagcgccgaggacaaggcggcggccgagcgctctaagatgatcgacaagaacctgcgggaggacggagagaaggcggcgcgggaggtgaagttgctgctgttgggtgctggggagtcagggaagagcaccatcgtcaagcagatgaagatcatccacgaggatggctactccgaggaggaatgccggcagtaccgggcggttgtctacagcaacaccatccagtccatcatggccattgtcaaagccatgggcaacctgcagatcgactttgccgacccctccagagcggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctactacctgaacgacctggagcgtattgcacagagtgactacatccccacacagcaagatgtgctacggacccgcgtaaagaccacggggatcgtggagacacacttcaccttcaaggacctacacttcaagatgtttgatgtgggtggtcagcggtctgagcggaagaagtggatccactgctttgagggcgtcacagccatcatcttctgcgtagccttgagcgcctatgacttggtgctagctgaggacgaggagatgaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggggccaacaaatatgatgaggcagccagctacatccagagtaagtttgaggacctgaataagcgcaaagacaccaaggagatctacacgcacttcacgtgcgccaccgacaccaaatctagaaaactttttagagaaaactatttaaaactgtcagatcctgaccagcaaccccccccagccccccttccaagtgactccgtgccttga

SEQ ID NO: 13009 - DNA, 3206 bp, Homo sapiens
agctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataatctaaaataaccaataatccaaaaaagttcatttt

SEQ ID NO: 13010 - DNA, 2417 bp, Homo sapiens
ttgattgcaggtcctcctggggccagaagggtgcctgggaggccaggttctggggatcccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcgcaagaagtggatccactgcttcgagggcgtgacctgcatcatcttcatcgcggcgctgagcgcctacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaagatcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaatttgtcttcgacgctgtcaccgacatcatcatcaaggagaacctcaaagactgtggcctcttctgaggtgcctgaattcatgcgtgtcagtcaccctgagacctggtagccctagctgccttgcagccccaaaccccaggaccctatcagccccctgggactccctggccccaacctgccacctcaccaaagctctgagccctgctagccttgaggcgcggaccctcccccatacctcccacagtatcccagcgcctcatgcccccaaccccaagccctgcccttcaccgcccggctgcactggcctctaggactcacagcagccagccccagctaggaacgggcaggacttggggcagctgaagctcacggtgactcagcagtgcccaactgaccaatctcccgcagctctcctgcccctgggggcccacgactcacctggtgggcctgggctcagcaaacagccctccctcccagtatttcatcaaggacagggaatatccctcccacacacaggccagctgctcaccctgccacctccatgtgacaagtttgacacctgtctacccagagccagtgactgtccctcccagcagcctccaaagggtccaaagtccaagctagctctggcctgtgtggcccccacataaataaattagtggggagggggcagacctgggggcccttgggtgccagagtgagacacagcaggacccttccccaaatactaggctcagagcaacctccagccttctccagcaggatctgctccctgtgtccttggacagcagatccacacaccacttccccacccacacacagtaccctgggctggttggacaacaggatggtgtgttaaggggttaagggagggtactgttgacaccagctatggccaatagctgggctgtcctgaggggtggctggggacagagtccagctcccttggatcagcccagaggattcaggataggacaaaggccctggctgtgcccaaaagggtctacctcaggtggggttacaagcaaacctgggtgaccctcttgtccctaccagcagcttctcttgccccttccattcagggttccctggcaggggaagctgagagccatggctgaactatcagggacaaaggcccatgtccccacatccctgctccctccttcctcatccagcaccaaatctttgcttatgtccacaggccagggcctgtgctgcagtcggggacaaggagcttccgtctggcaaggccggggcacaatttgcactcccctcagctagacgcacagactcagcaataaacctttgcatcaggc

SEQ ID NO: 13011 - DNA, 1224 bp, Homo sapiens
ccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcgcaagaagtggatccactgcttcgagggcgtgacctgcatcatcttcatcgcggcgctgagcgcctacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaagatcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaatttgtcttcgacgctgtcaccgacatcatcatcaaggagaacctcaaagactgtggcctcttctgaggccagggcctgtgctgcagtcggggacaaggagcttccgtctggcaaggccggggcacaatttgcactcccctcagctagacgcacagactcagcaataaacctttgcatcagg

SEQ ID NO: 13012 - DNA, 1339 bp, Homo sapiens
ctcagtcaatgtaggcagagtacaagaccctacagcctgctctctcacctgccatcgtacagaccagcttttaggggagccaagttgggatactcaatcccaacttttttccttctcttccatctcacatacaggaaaccttacgagagaggattaggggcctgaaaaagctgacaagacggcaaatatgggaagtggagccagtgctgaggacaaagaactggccaagaggtccaaggagctagaaaagaagctgcaggaggatgctgataaggaagccaagactgtcaagctgctactgctgggtgctggggagtcaggaaagagcaccatcgtcaaacagatgaagatcattcaccaggatggctattcaccagaagaatgcctggagttcaaggctatcatctatggaaatgtgctgcagtccatcctggctatcatccgggccatgaccacactgggcatcgattatgctgaaccaagctgtgcggatgacgggcgacagctcaacaacctggctgactccattgaggagggaaccatgcctcctgagctcgtggaggtcattaggaggttgtggaaggatggtggggtgcaagcctgcttcgagagagctgcagaataccagcttaatgactccgcatcttactacctgaaccaattagaacgaattacagaccctgagtacctccctagtgagcaagatgtgctccgatccagagtcaaaaccacgggcatcattgaaaccaagttttccgtcaaagacttgaatttcaggatgtttgatgtgggagggcagagatccgagagaaagaagtggatccactgcttcgagggagtcacctgcatcattttctgtgcagccctcagtgcctatgatatggtgctggtggaagatgacgaagtgaatcgtatgcatgagtctttgcatctgttcaacagcatatgtaaccacaaattctttgcggctacttccattgtcctctttctcaacaagaaggacctctttgaggaaaaaatcaagaaagtccatctcagcatttgttttccagagtatgatggtaacaactcctatgatgatgcggggaattacataaagagccagttccttgacctcaatatgcgaaaagatgtcaaagaaatctacagtcacatgacctgtgctacagatacacagaatgtcaaatttgtgtttgatgcagttacagatattatcatcaaagaaaacctcaaggactgcggcctcttctaatcctcaccattcctcaggtataagttctataaacaggcttggaatctgggtaattaaaaacagaaaattatagtcaatataccatga

SEQ ID NO: 13013 - DNA, 3340 bp, Homo sapiens
ggcggcgggcggcgggcggcgggcggcgcgggagggcgggcggagggaaccaggccggccggagtgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacattttttttttgttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagccca

SEQ ID NO: 13014 - DNA, 1429 bp, Homo sapiens
agatgctctgtgctgcggcccggaggtgaagggctggatgcacagtgggagccggaggcggggggctgcagggagcacaccagcgaccggccctccaaccctccagccactcagcaacatcgccacagcaaccagcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactt

SEQ ID NO: 13015 - DNA, 3091 bp, Homo sapiens
ctcacctctcaccatctgctctgtggctcccagtgctgactctggaagctttatcttgggtaaaagatgtgtgatcagacctttctcgttaatgtatttggctcatgtgacaaatgtttcaaacaacgagctctgagaccagttttcaagaagtctcaacaactcagctactgttcaacatgtgcagaaattatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttgatcatttgcagagca

SEQ ID NO: 13016 - DNA, 1735 bp, Homo sapiens
atcgcggagggcggggccgcggggcggtgctcggggccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagc

SEQ ID NO: 13017 - DNA, 2678 bp, Homo sapiens
gcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattata

SEQ ID NO: 13018 - DNA, 2217 bp, Homo sapiens
aacagaggacatttaggctggatgaaggcaggctcagggggctaccacgaccatcaggcatctgaagcccctctgtggagacccatcagactcgctctgtgttgccccggggcagggttggggatgaaagggggcaccagtagccatcagtaatcatccgcaaagggctctcttgtggacacttatgctgcaagagccacttcctccacggtcttatcacctcacccaggccctgtggagcagccagaaggcagggagagcttctcccttgcaggtcccctccattgctgtcagtacccagctggctccagggctctgtgatgccgccagctgggcctatgagggccccgaaccctgagtcctcactgcctttctcccaatcccaggaaggtatgctcagccagagcccaggcctcatacacactggcagtgacaaaaagtaaaattccagccctgtccccatgtctttccctgggcacccctgtgtgcctttactctatggctgacctttgtacttgtaagctatccagaggctctttgggcctctgccagagtttcctaaaacatacgtttgcttttctcattctcctgcccagaagcttccagagtgctctcttggcttcagactgagtccccacctgtgaacgggctcacctttcatttagtgcagacataggcccccctggagtttgtctctccccttcccttctttcacctggccagctctcactcttccttgaagaccaactcagatatcaccacactgggtttgggaccctcctgtgtgcacacctggatcccagcacttctcatgctgttgtcattgatccttgtctactggtgatgtcaactccccaagcgaacatcagaaatacttgcaaccaagcaaagctaaggttatctgacctgccacagtaagggagaacctccacttggcagaatcttagtaggttctgaaaatggaggaattagggaagggtacttagaggatttcagggtccaggcttggtgattttaaggtgggtcttgcaaggccgttttagctttggattggtgagcccagcaagcgaacagtctttgagtctggatgagcaagctgttaatcttgatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttc

SEQ ID NO: 13019 - DNA, 1176 bp, Homo sapiens
tggctggaggcgtctgaggggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaa

SEQ ID NO: 13020 - DNA, 3132 bp, Homo sapiens
aggcgtctgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgaggga

SEQ ID NO: 13021 - DNA, 1240 bp, Homo sapiens
caggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtg

SEQ ID NO: 13022 - DNA, 628 bp, Homo sapiens
gtcggcggccggagcccccgcgcgggccgcctatcgggtggagatggggtttcaccatgttgaccatgctggtctccaattcctgacctcagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggtacctgtcct

SEQ ID NO: 13023 - DNA, 423 bp, Homo sapiens
ctggaaggtctgggggactgagggaagcgaagagaaaagcaagagcaattaaatatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttc

SEQ ID NO: 13024 - DNA, 514 bp, Homo sapiens
gcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgaatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggtacctgtcct

SEQ ID NO: 13025 - DNA, 2827 bp, Homo sapiens
gcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgaggg

SEQ ID NO: 13026 - DNA, 6706 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaagttgcaggcttgaggtgggagctccctgaggaggccctggtcccccacttagcatcagtgccctcagacccccaccaggcaggatgctcagccccaccctcacacctgctgttgaatgggccaccccgagtgtgggtttcctgggccaggcctcaggagatgataggccccaaccatagctgcgtcgatgtccacatgacccctcaccccgaggaggccaggagctcccaacacacaggttgaggccaggatcaggatcaggaagtaactgaactccctaaagagtgaagcagagaaaggtgcctgtgagggacggcaaggggggcttgcagcgcacagggccaggccagatgtgggatccgggagggcacgcctgcccgcagagggtgcagtggggaaggcgcacagggtgcacctccaggtgagtgctgggcagaaggcacgagagcagcaagggagtgtgacaagcaccgcctcacagtggccaaggccacagtcacagctgcggctgcacacagggtggcccccagggcacaacacagcaagagcaggacttagcagccagagcctcacactgcatgcagccgggcccagcctggccggtcgtctcctcctaaaagcgggtgttgattgggaaagaaccatgaccctgaatattggagtggggcccatgggcagatccagagaagctgggaccacacacgcctgtgtctgcccggattgccggaagagcccctctagctgaaggcccggggtggcctcccttgaggcagttgccctgcaaggccctgccgatgctccttgggacccccacctgggcttctagtcctagaactagactcgagtccagcagacccccaggatgagatacagagggtgaccctgagagtggcaccagcctcctgcaggaccacatggcatttccaggtttccaggcagaaatctgaacatgtgtgggacggatcggaagggtgtgggatccaggtggccggagcaggggtggatcaggggagttcccggaacagacctgccaaacggagggctggactgggcgctgcagcttggggccaggaaggctccagtgccgggctgggggtgggggctggattacagcctgagggtggctgcactgagtgaagtggacatggccagccgccgtggggtacagccgaggagggcttccaaggcctggggatgggggtgttggatttgtcagtgagacctgtgcacccactgcagggggtcccaaggccgtgcctccccaaccccactgtgaggaacatggttgctggggggcccggagtccttgaggagtcctgtgaccacacttctctgttggtcagaggtaccatggggaccgttccatcaaacgggaatgtcagtgctggccgggaaagcggcccctggcccaagcttggagaccacctggctcgggtactggcctggctccgttggacaagggtggccaccaggtgcccaggacctttggagaggggggccctgctgcttttcctcgagtgtcctatagccgccaggatgcgtagggcactccgggaggtattttcatatcactgaggtgtcagggaggggaagggtcctgggtttaggctgcagtgactgcaggtgctgagggagctgtgccctgggtgctcatcacaggctgtcacagtgagggaaggtgtcaggttctgacatccccatgacagcggcagggtaggtggagtgggaattggctttgcagtttccctgcatgcccttgacagccttgccaaaggcacatctgccccgcctcagctcccaccctgagggttctgggcctctaccccttcccctgtttatgtccctgtcatctttggcatcatcactgtagttacaaaactccctacgtcccacagccacgaggtgggtatcccacatgagggcccaggtgtgcatgccagcatgaggttggcgagtggcactgcctgctgatgtcttacatagaggccatgaagagctgtgggcagggtgtacagaccctgagttggcccctggccctcgtgctttcagtcaaaggcacaagcagggtggatggcaggcggctgccccctagcctggccttgagctccctgccccaggccatgtggcgttgagcagtgtccaggcacatcttgttctgaatctcagtgtgcagggatggagtcgggacagcgtgagtcctgcatgcctaacacagccctcacccctccagtgcacaacggggccacgtgcccgcatctgggtggctaggcagatagggccccccttgccaggcagatccagcttctgaggccttatagacgtcctgtggagggcaggcccaggactttcattcacctggctgagctgcctgggagagcagcagaaccggtgctggggtccaagccggccaagagcagtgcagccctcctggtcctgttcctctcttgagctgctccgtggtgtccacagcagagccatgtggctctggacaggtcggcctttgtgtcaacagaacctgggtcgtgatgaatcaccatgcgtctgaccagccttgaaacccccacaacagaagaagaaacggtctcagctccagacatccagcttggaaaagatgcacctgaacattggcattctcttcctagcaaacagccacttcctgtaggctggcaggaacgccaacagagccagcagtgaaggcattaagtggggaggaggggtggcccggaggcagcacgcgaaggtcagcatgcagctcctgggatgaacctgagaggcgactcctggcagcatggctggtcgctgccatcacgcccctggccaacccaccaactgggagaggcagcccttccacatcttcctccataatgctcttgggtagcagtgaggcctctcaagccagagagaacttggtgtttggaaacaacggcggacatttcttgccattttcagtgccaactcaggtaggtgtgttctaccatcctgtgtttttggggtgtttttttttttgagtcagagtctcactctgtcccccaggctggagtgcaatggagcagtctcggctcactgcaacctctgattcccaggttcaagcgattctcctgcctcagcctcccgagaagctcaggaccacccacataggtgcaggccatcatgcccagctaattttttatttttttttatagagaaggagtctcgctatgttgcccaggctggtttcgaactcctgggctcaagcgatcgatcctcccgcctctagcctcccaaagcactagaattataggcctgagccactgcgcccggcccaccatcctgttcttattggaagaatttccatgtgtcgaggcacgggcacaacgtagctggtcctctgctcagggccccacaaggctgcgtcagggtggcagcgcggctgggggctttttctgttcaaatccagattctcgtggctgtgagccccagccctgggcactgtccgcctggtggtgtcttcacagccagcaggggtggccttggggtgttctgtggagtaactttcacggcccagagtgggatcctgagtggctggagccgtatgctccagcatccccagccgctgcctccggtgcaggtggagtgggcccctctgattaccaggagctgtcagaggggcagcaggtcccactccactggccggtgggcagctgtgtgcagggacgcgggtcctggcacgtctgcctggtgaggccctgcctccagtgccaaggggcctcccctctcgacggtgggcgccaccatgtgctgacctctgtgcagccccactttacaaggtaggttcggccagcaccccatccgcgggcgggcagcactcacccagcgttgcgccgccaacagggtccctcttagacaagcagctgtgcctagagccttttccttcctccctgcgtgttacctgcaggccaacagacggccctgggtctgggaccaggagaacctgcctccgcctctggcagtgggtgtccctgcaggcagattgggcttggcacgtagacaccgaggggtcagccgatgccgggagatgatcccgggaagggctccggagcacagcccaggacccgccgccgctgctgggcgctccatgttgacgtgctgtgcgtgtctccactccccaggcaatgatgttcaatcaggtgtttcccacctgtgtctctgccaagaagccacagaacaccctctgcacaaaaggagtgtttgcacaaagaaaaacaaccctccgggggttctttagaaatgcttatactcaattagctagaacttcatgtgaaatcccagcgtggaagacaacaagccggcaccggtgaaaactttgctgtgcacctgccctctaccaagctgccagccccaccagccctgtggtcctaggtgggcacagctgctgcacggtcccccaggcctgcctctcctcggggtctcaaccttcataccagatttgccagcatccccattcccgccttgtgggtggagagtccttgagaccctctgtcactctgtcagcttccccaggtcagcgagctgtggcttggctcccacgcatcagcttttatgggaggcccattaggagctgggcaggagggacagaggggaggccaggcagccactgctgagtgggacgggtagcccagcccatgaggctggccagccctacaggggaggtcccacagcactggccgggaagtccacataggaaagcatcagttgagggatgaagccacggacgatggggacaacggccacagggtgtgctaagctgaggaaattagtaggaggtgctcataagctgttttgttttttggtttgtttgtttgttttttcttttaagagaccagggacagtgggggtctcactctgtcacccaggctggagtgcagtggcatgatcatagcttactgcagcctccaactaataggctcaagtgatcctcctgcctcagcctcccgagtaactcatggcctttaagtgaactgcttccaccatccagctgtgcaggtggcctgggaacagcagcacatctgtcccctgccacctcttgcatgcacacttgacctcctgacttgggctctgaaacctgtaaaatgtggggtgtagagaaatcgagtcatttggcctcatcctggtgccattatctcttgctacattaataaaccacctcaaacag

SEQ ID NO: 13027 - DNA, 1699 bp, Homo sapiens
ggcgttcccgactccggcaagagggtcagtgtggaggcgggagcccgggcggccggcttgaactccgtgcacgcgggcctggagctgcgcccctgcgtcttttcccgacttctgatccgcagaggggcactcggagccccagcctgggtcgcagtgccttcggtctgcgggcctcagtttctcggtccgcgccgggggtttgtgggggcacctggagacatttgggccgttctcgcagtctcgggaagccgcgcccgctccttgcctggcctcacggcggccgatctcgttctccactttctaggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaa

SEQ ID NO: 13028 - DNA, 1076 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgc

SEQ ID NO: 13029 - DNA, 1878 bp, Homo sapiens
tccagtcccagaggggggatgtcttactcctttccgtgaagcaaaccctttgagtacggtttgcgtccacaaagcgtagggtgagaaccttgggagcgactgggcccgtctttgctccctcggtggggttttgtctcctggcttcccccaagtgcgaggcagttggtctcgcccagccgggtcctgggcgcggcggcggcagccgcgtcactggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctgg

SEQ ID NO: 13030 - DNA, 1524 bp, Homo sapiens
cggcggcctcgggcctgacgtcagccctgcatcccccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctgg

SEQ ID NO: 13031 - DNA, 1641 bp, Homo sapiens
ctcgagagcggctcccacgggctttctgcgggcgcggcggggcgggcggtccctgcgctggagggagcagcggctcggggctgccttccccgccgctgtcacccccacccgcggcggacggctaatggggcgcagccggaccggggattatccggggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgtacctgg

SEQ ID NO: 13032 - DNA, 545 bp, Homo sapiens
ctttctccccacttccccggcggcctcgggcctgacgtcagccctgcatcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctg

SEQ ID NO: 13033 - DNA, 1285 bp, Homo sapiens
gccgccgccgccgccgccgccgccgccgcctccgccgcggaggaagacagcgccgcccgcgcaccgccagcgacctccgccgcagagtcccaccgccacaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactc

SEQ ID NO: 13034 - DNA, 1478 bp, Homo sapiens
cgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtt

SEQ ID NO: 13035 - DNA, 1146 bp, Homo sapiens
cccgcgcaccgccagcgacctccgccgcagagtcccaccgccacaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccat

SEQ ID NO: 13036 - DNA, 910 bp, Homo sapiens
accatcgaagctgggggtgtgtgtggagggtgtgcgccttgtggggtgaatttcaagaggcaccgccccttttaaaattaggtgcttggagggcggtgcctgtgcgggctggggcagaagccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtgg

SEQ ID NO: 13037 - DNA, 1479 bp, Homo sapiens
cgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaa

SEQ ID NO: 13038 - DNA, 887 bp, Homo sapiens
tgaagcaaaccctttgagtacggtttgcgtccacaaagcgtagggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggatgcccgaaaagcatgtggggactcaacactgacccagatcacagctgggctggacccagtggggagaatccagatgaggacccggaggaccctccgtgggcacctggcaaagatctatgccatgcactgggggaccgactcaaggctgctggtcagcgcctcccaggatgggaagctcatcatctgggacagctacaccaccaacaaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactgggtacctgtcgtgttgccgcttcctggatgacaaccaaatcatcaccagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttccccaacggctacgccttcaccaccggctctgacgacgccacgtgccgcc

SEQ ID NO: 13039 - DNA, 1923 bp, Homo sapiens
ccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagagccagagtgacccctcgacctgtcagccatgggggagatggagcaactgcgtcaggaagcggagcagctcaagaagcagattgcagatgccaggaaagcctgtgctgacgttactctggcagagctggtgtctggcctagaggtggtgggacgagtccagatgcggacgcggcggacgttaaggggacacctggccaagatttacgccatgcactgggccactgattctaagctgctggtaagtgcctcgcaagatgggaagctgatcgtgtgggacagctacaccaccaacaaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggttatctctcctgctgccgcttcctggatgacaacaatattgtgaccagctcgggggacaccacgtgtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggta

SEQ ID NO: 13040 - DNA, 3321 bp, Homo sapiens
ccccggcacgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactctgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgctttcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaagttaaagatacttttcctgttggattctcttttacaaataagtctaaatgactgataatagaagattgttagtcttgcttgatggtaaagtcttggattattctgatatatagacgtgcattgttttgtaacttagttacttttcagataggtctgtgttaacttttgaacatgtgtaacttaacctaaatactcccaaactttacctctaaatttttgtttttatgttgtgaatgtgctaatatgtgcatcaactgtaaagatgtatcagttttattaaaatcagttgacaattagaataataaagtggataaaggcaaattaagatataggaccaaaacagaatattgtagatggcagttatgaatgtatatttatattttgattaagatttctattaactttttggctgggcagagtggcttacacctataatcccagcaatttgggaggccaaggtgggcagatcacttgaggtcaggagttcgcgaccagcctacccaacatggtgaaaccccatctcttctaaaaatacaaacattagccgggcgtggtggcacattcctgtaatcccagctactcgggaggctgaggcaggagattcgcctgaacccgggaggcagaggttgcagtgagccgagattgtgccactgcactccagcctaggcgacagagtgagactccatctcaaattggaaaaaaaaaaaa

SEQ ID NO: 13041 - DNA, 1360 bp, Homo sapiens
agctgccacgcgggaactggccccacgaccgccggcgcaggcacttcccgggcggtccagaccgctcgccccggggagcgaggaacggtcggcggtccaagtcctgcagacccccctggtttctcgtcactccccgaggcctccttccaggaactcagagcacgagcccctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactctgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaac

SEQ ID NO: 13042 - DNA, 571 bp, Homo sapiens
ctgggtgtggccggcggctctggtctcggctgtgagctgcgctctccacgccggctccgcgctccaggggctgctgagcgcccagcggacaccggcagcgcgcggtcgacgcgggcctgagctccctccagagatggatacctgccatgtagcccaggctggtcttgaactcctggcctcaagtgatctgcccacctcagcctcccaaagtgctgggattatgggcatgagccactgcgcctggcctatcctgcctttgtgccaggcagtcctcctcatgtgtattacagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactctgtgggtcgaatacaaatgcgaacaagacgtacactgaggggccacctagctaaaatctatgctatgcattggggatacgattccaggctgctagtcagtgcttctcaagatggaaaattaat

SEQ ID NO: 13043 - DNA, 975 bp, Homo sapiens
cgctctcactcgcggtcgcctggccgttgtcattgtccctccgctgtcaccttttcaagccccaggctggctgcttcagaagcccctgaccccatggaggagtgggacgtgccacagatgaagaaagaggtggagagcctcaagtaccagctggccttccagcgggagatggcgtccaagaccatccccgagctgctgaagtggatcgaggacgggatccccaaggaccccttcctgaaccccgacctgatgaagaacaacccatgggtggaaaagggcaaatgcaccatcctgtgagccccgcacccggcccctctcacaccatcctgtgagaccacgcccggccccactcccaccatcttgtaagactgtgcccagccccactcactccatcctgtgagtcccactcccagccccactcccaccatcctgtgagcccatgcccggccccactcacaccaacctgtgagccccactcccggccccactcactccatcttgtaagactatgcccagccccattcactccatcctgtgagtcccactcccagccccactcccaccatcctgtgagccccacttccagccccactcccaccatcctgtgagccccactcccagccccactcccaccatcctgtgagccccactcccggccccactcactccatcctgtgagccccactcccagccccactcacaccaacctgtgagccccactcccggccccactcacaacatcttgtaagactgtgcccggccccattcactccatcctgtgagaccacgcccggccccactcactctatcctgtgagaccacgcctggccccactcccaccatcctgtgagccccactcctggccccactcacaccatcctatgagcccacgcccggccccactcccaccatcctgtgaaccccactccactcgcacgtgattacagtctgtaaaggtgtgactttataaagaca

SEQ ID NO: 13044 - DNA, 3729 bp, Homo sapiens
aacaaagggagaagggggattaaagtcaaatcactgtcagcagcccaggagcagacaaaaccaccagagtaagccctgaaatggaaatgagagggaaaagaagcaagccgctaacagctaccaagaagaggaggaagtgggagatgcgctgcttcctgtagaaagaacgttgattgaagacaaagctgggtggggactagtccctgggctgcagccgctgctacacatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattc

SEQ ID NO: 13045 - DNA, 577 bp, Homo sapiens
agagcatgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccct

SEQ ID NO: 13046 - DNA, 569 bp, Homo sapiens
agtgtcttcctccctcagcttgtgcagctgctttcaggataacctcagacacagctatcatttgccaccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcc

SEQ ID NO: 13047 - DNA, 908 bp, Homo sapiens
actcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagggatgatactgtgaagtgttcaggaatgaagtctcgtgatgtctgctacctagtttcaaatggcaggagagacagagggatggggaagcaaaagtgaccattgttaactctaggtggttgtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaa

SEQ ID NO: 13048 - DNA, 3419 bp, Homo sapiens
gtttttctctctgctttctcaacagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatgaaaaaggaagagaaaaagtttgatatgccaaggacagattttgaaacagacttggtaaatgttttccttagctccttcatgggcatgctggtgaaagaataaatacatccaattaaagctcatgctggggtcggggagaagaggatactgaaacatttgtgaaatgtatgaatgcacttctgtaaccagatacttctgttcttctgttcaaattgtggggtttttgttacagttaggacgcccatgaagatttaggggtgaaaaaaacagcagagtatttattaaactacagcattgtacaattagcttagtaacactatggaataagctaaaacatatcacagtttttacatgggccaaaacatgaattgagtatgtggtcacatgaaaacacggatgaatgaataaaacactctttggtggtgactgaggcatcattagaaggcccagacgatttccactattcacagcatttccttttctcagaaggactctttatatttccatgtaaatctagatctttggagcaattaagatggaattacaatttctagggagcattttaaggaaaatgttttggctttttcataattttatgtcttacagtatggaattataatacgaaaatctttatatgagttttggcttcttggtatttgtacttattcaggggaaaaagtctttcgattacttatgcctctatagagcttaatttcttgagaaattcaacagtcattttcaccagcataattttatcttaaggaataactaataggaaaagtcagcttaattatttaaggccctagtttctacatataatatattcgatagaaatgaaaatctgccgtggaattaactaataagtagtaacaataaacttcatatttagaatgcaaagtctataaagaataattttacatgatcctcaatatcaactccagtttaaaaagtgttatttttaaaacatttgaaaccaagtactgtttaatttcaatcagaagatgcaaatacatactttgatctatgtttgattttgctaataatatttgaaggagattgcctaccaaggacaaaacaataaatttaaaaatcaaacgatttctccatacgctcatagtcacatatggaattttgagaaaataaagcatgctgtctttaggaatttttatacttctttgtctttcttccttaatatttgcttctagctgctcttggcaatgatgaattgttatgtatgcattaatgttttgcagcccaaaagttgttcacatttttcctatataagatctgtggagtgtgtgtttcaaagagagaactacagaaatgttaaagcaggaaaacctgaatgtgatgtgcacattttcatcccacatggacaatgtatgtgttttaataaatggaattttcagattca

SEQ ID NO: 13049 - DNA, 2125 bp, Homo sapiens
acaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttctttttctttcttccttctcctctacccctccttccacccctccccattagagtagtgtggagataaggctggactggtctatcagattgaactccaagaatgatcacacaaaatgtttagggagatgttccccgtggtgtatcctcatggtaacaacgacaaaaaatgccggttgtctgtgttctcttttcactattcctaacatgtgtacatgatagctttgattctgcaagtaaaagtaaatcctgtgttgtgactggtgctttcatatatttgtgacaatttttgagtaatattgcatgaaaatgtccctatgttacatccattcagaagttttgttgttttactctaaagctgggaaaggaaatgagagggaaaagaccccggagagggaagaaaatctcagtattttgaaaattgagattacttcagagccttagccacacctaaaatacctcctagttaatagtggtataaatgcctcttcaatacgttttccagaatccaaagcattttggtttatccaggacccagggcagcacagctgtcaccaagcaggagagttaaggattcaccatgagctgggaaatgcttttgccatgagtatgagcaaattccctctttccctgaatcatggacattctagattaaaagaacatttttttgtgctcttaacaagaaaaccatggccctcctttgttcaagtatcagaagaaataaacccacagctccagagaaggtgaccattctcagaactccagctattcactctccagggagaaggacctcaaatcgccactctttgggcggcaggtgcggtccccacggccggctctacgaggaagagttctggctcttttgtccactgagatggtcttggtttttcacttaacaaattttttaatggaatctttgtttttgttctccatcttgtttgttagagtctctcggcctttatttacaaattccttgcaactagagcgctccttccccaagatatggtagtgagagtaatttttcattgtagctgtagtctccatcagtaacagcaggccctggaagacttgatcacctttttctgtgtcattttcagtcaaagagggcctctcttacatcttgtttgctttcaaatccccaaatatcatctccatctcccaattaattttattgtctctttcctctctattcgctttctcctgttttttttttaaaaaaaaagcatg

SEQ ID NO: 13050 - DNA, 573 bp, Homo sapiens
atgcagagccagcaagagcggatggctgaagaattacacgcagtggaaaagcagcaccgtggagctgggtgattcctgagcccaacctgtgcctctggtctaggggcatgcaggggaaattgcaacctccaatggaaagagaagcaagagatggtgtaccttcaggcaaagacaagaatcccagagcatagaaaagtcacacagctaattaagtgttggagcccggatttgaacccagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcat

SEQ ID NO: 13051 - DNA, 920 bp, Homo sapiens
cttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatcggcccctctggagaggaaaagaaaacttaagagtcgggtcgcgctagcctccagcagccgccgcgcccaccgactgctccgccccttctcctccccctcctccaggctcgcgctcggggccgggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaa

SEQ ID NO: 13052 - DNA, 790 bp, Homo sapiens
cttcccacaaactgggaggaaaactgagacctcctggtcacccgccgccgggccttttagaaactcccacaagctctgccttccctccctggtcctcttcagaccccctcttagttcttcgcggctaacggctcgcgctcggggccgggtgtggagctggaacagagggctggcaaggcgcgcatgcgcaccgagggtggagccgctgagcacagaaccggaaacttagagacaaagttcggagccccgcccccgccgcgcgccgctgagttgtctggccccgccgacccacggcccacgacccaccgacccacgaatcggcccggccgtcgcgtgcaccatgtctggctcctccagcgtcgccgctatgaagaaagtggttcaacagctccggctggaggccggactcaaccgcgtaaaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaacttt

SEQ ID NO: 13053 - DNA, 720 bp, Homo sapiens
aatcatattagtgaagattaggaagaagctttaaaatcccaaggctagtgtgcattgctagaattgttaagagagagagctcatatgaaattggttatcgtgggatatttaaaataaaacaaagaacagtttactttcaggcaaaaagatgccagtaatcaatattgaggacctgacagaaaaggacaaattgaagatggaagttgaccagctcaagaaagaagtgacactggaaagaatgctagtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgtggtaacccatcattctatgtttttcttaacatagctggcacagggtttaacacataattgccaataaatattgcttaaagttctttaaaaagaactatgttttataaatgattctatattattctgagttgtcagcatatatttactgttttatgttttttcacttccctttcaacacttacaattttctaccca

SEQ ID NO: 13054 - DNA, 538 bp, Homo sapiens
gctcatatgaaattggttatcgtgggatatttaaaataaaacaaagaacagtttactttgtaagttaagagctgagggaattgttggctaagactgacttgaaataactccagcaattcatgcatagctgctaaccttctacatcttcagcaggcaaaaagatgccagtaatcaatattgaggacctgacagaaaaggacaaattgaagatggaagttgaccagctcaagaaagaagtgacactggaaagaatgctagtttccaaatgttgtgaagaagtaagagattacgttgaagaacgatctggcgaggatccactggtaaagggcatcccagaggacaaaaatcccttcaaggagctcaaaggaggctgtgtgatttcataatacaaacaaaaagaaaaaaaattaaacaaattcttggaaatatctcaaatgttaataacaatatgaatttttctcatgcatactattactactaagcatgtacgtgaatttttaaatttatagatgtaaacttttaataaaaattggggtgt

SEQ ID NO: 13055 - DNA, 889 bp, Homo sapiens
tggatgaagagtgagctaggagaacttcgtaaggtgaaactgtggggatccaatgggcaacacaaagcatcttggttaaggaggttaggggccggtctaggacttgcctcaggaggaaggacagcctcagagcatgctcagaggtgggaagggaaggaggagaaagcaggcgaagcggggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatttcctccacctgctgggtctctgctgaccttgctgggaacactctgaggacagtgtggctggccgagcggttggccccatgggtggtggggtgtgagaagcctgcaataccccaagaccccagagggcagtccttaggaagcacttacaccacctgggaacccctccgtcttttccctctactctcatcct

SEQ ID NO: 13056 - DNA, 585 bp, Homo sapiens
attccgggacaagaggaagtcagtcctgctccccgagcctgtgtctctctgtcccctgcccagaggaagggggaagccaggggcccatttgggggcccagcccccaatcccacccagcagaggaagccaaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaag

SEQ ID NO: 13057 - DNA, 918 bp, Homo sapiens
tttttattgaatgagtggatgaagagtgagctaggagaacttcgtaaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatttcctccacctgctgggtctctgctgaccttgctgggaacactctgaggacagtgtggctggccgagcggttggccccatgggtggtggggtgtgagaagcctgcaataccccaagaccccagagggcagtccttaggaagcacttacaccacctgggaacccctccgtcttttccctctactctcatcctaggaataaagcatttccacgccagagtagtttgggctgggggccagggttgggtggtcctgtccctccatatcatgtcctaccctatggtcctgttcctagtcatttagatcaccccagatggcctgatgacaacaagagtttgtgaagttatgatttca

SEQ ID NO: 13058 - DNA, 500 bp, Homo sapiens
tttttattgaatgagtggatgaagagtgagctaggagaacttcgtaaggtgaaactgtggggatccaatgggcaacacaaagcatcttggttaaggaggttaggggccggtctaggacttgcctcaggaggaaggacagcctcagagcatgctcagaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctga

SEQ ID NO: 13059 - DNA, 783 bp, Homo sapiens
ggcgaagcggggtaagtggggctgcagggtggaggtggagaaatagaagcgctgcgggctctaagctagtgaggtcaccaaaagtgtgaggctaacgcaaggcaaggtggtgaaaaggtggcttctgttttcgcgtttgtttttgtggggagaatgtctgtctctctgctctgctgtagtgagggcttgaaggctcaagcgggtgatgggcttagaactttgagcctatgatcagcttaggcatcagagattttggtttccaggccatctgctttatctgaagattttcagctgatgaagaactaggaggctcaaacactatcttacctgagtccaggacaagtgacttggagagtgtgctcttctgtggcaggatcaggtctgtctagggcaggatggcccaggatctcagcgagaaggacctgttgaagatggaggtggagcagctgaagaaagaagtgaaaaacacaagaattccgatttccaaagcgggaaaggaaatcaaggagtacgtggaggcccaagcaggaaacgatccttttctcaaaggcatccctgaggacaagaatcccttcaaggagaaaggtggctgtctgataagctgatggcatggagccctgccctgagtgtctgtccctcttcagccaagcccaagtctcctagacccccagggagccagtgaactgtcaccttctcttcatcacagaatgagtaaagatccctgaacaaatgcattgtgaacccattccccactcccaccttcaactcttttctcccattatt

SEQ ID NO: 13060 - DNA, 6539 bp, Homo sapiens
cgtcggcccagactatccgctcccaccgcgcccccggcccacctggtggccccggccctggccgccgcccccgcggcggttcccggagctcgtcccggacgcgcgcccgggcggcgggggctcggcggccaccgctgcctcgggggagcgagggcgggagggtgtgtgtgcgcgctgtgagcagggggtgccggcggggctgcagcggaggcactttggaagaatgactctggagtccatcatggcgtgctgcctgagcgaggaggccaaggaagcccggcggatcaacgacgagatcgagcggcagctccgcagggacaagcgggacgcccgccgggagctcaagctgctgctgctcgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttcccaggttacaatggcctttatcctagttccattcttggtcaagtttttctctcaaatgatacagtcaggacacatcgttcgatttaagccatcatcagcttaatttaagtttgtagtttttgctgaaggattatatgtattaatacttacggttttaaatgtgttgctttggatacacacatagtttcttttttaatagaatatactgtcttgtctcactttggactgggacagtggatgcccatctaaaagttaagtgtcatttcttttagatgtttaccttcagccatagcttgattgctcagagaaatatgcagaaggcaggatcaaagacacacaggagtcctttcttttgaaatgccacgtgccattgtctttcctcccttctttgcttctttttcttaccctctctttcaattgcagatgccaaaaaagatgccaacagacactacattaccctaatggctgctacccagaacctttttataggttgttcttaatttttttgttgttgttgttcaagcttttcctttcttttttttcttggtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacggtccattcttttctttgtccttaagatgacattgttagtgttcacgtcccatgttcagtgtccaaaccggcaatgtaaaaagtatcctgtgtggtttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggcttcgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcagaagtttgtgcctcatatctgaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaaatcagatcttggataaagaaattctgacttttatataagcttttggtagacagaaaaaacagaaaggtattcgttggtagaacatttttaagttcaggaaagaaagctggaataatactacgtaactttgtccaggttactttgactgaaacacgtttttggtggatttcttttcctcaaagaactctctaaatgcaactccttgctggattcctcacccatcatcctgttggaaacccttactagacctatgtatttagggagttttgtcagaaaacatttttaacttgcagtatttaaaagaatatttactgttcctaaaatgtcattcaaatgcatgtactgtctattgtttggggatgggaactagttttgcaaaaaacacctaatgttgtataataatgccccaatgatcttgctggttaaaaatacagtatttttggccataattttgtactatagtattcttcattgttgagttttgcttccattaaagttgcccgagcccctctcagaatgttttgtattagtaggagtactgaaatacatctttccttccttaacacaccttgtgcatattgcattttccaaaataaacaagtttaatggtttcaaaaaaaaaaaaacaccaaaaaa

SEQ ID NO: 13061 - DNA, 1273 bp, Homo sapiens
cactgcactccagcctgccagcctgggtgacagaccaagactccttctcaaagaaaaaaaaaaaaacaacttctaaatgcttcattaccgtttttcataggataaagaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtcattttcagaatggtcgatgtagggggccaaaggtcagagagaagaaaatggatacactgctttgaaaatgtcacctctatcatgtttctagtagcgcttagtgaatatgatcaagttctcgtggagtcagacaatgagaaccgaatggaggaaagcaaggctctctttagaacaattatcacatacccctggttccagaactcctcggttattctgttcttaaacaagaaagatcttctagaggagaaaatcatgtattcccatctagtcgactacttcccagaatatgatggaccccagagagatgcccaggcagcccgagaattcattctgaagatgttcgtggacctgaacccagacagtgacaaaattatctactcccacttcacgtgcgccacagacaccgagaatatccgctttgtctttgctgccgtcaaggacaccatcctccagttgaacctgaaggagtacaatctggtctaattgtgcctcctagacacccgccctgcccttccctggtgggctattgaagatacacaagagggactgtatttctgtggaaaacaatttgcataatactaatttattgccgtcctggactctgtgtgagcgtgtccacagagtttgtagtaaatattatgattttatttaaactattcagaggaaaaacagaggatgctgaagtacagtcccagcacatttcctctctatcttttttttaggcaaaaccttgtgactcagtgtattttaaattctcagtcatgcactcacaaagataagacttgtttctttctgtctctctctctttttcttttctatggagcaaaacaaagctgatttcccttttttcttcccccgctaattcatacctccctcctgatgtttttc

SEQ ID NO: 13062 - DNA, 551 bp, Homo sapiens
ggtgtgcatccattatcagtgccctatggggtcaggagggaatgggggaacggtgggcagactcgcagctggattcccggagcactcatgggacaggagagagtggcaagagtacgtttatcaagcagatgagaatcatccatgggtcaggatactctgatgaagataaaaggggcttcaccaagctggtgtatcagaacatcttcacggccatgcaggccatgatcagagccatggacacactcaagatcccatacaagtatgagcacaataaggctcatgcacaattagttcgagaagttgatgtggagaaggtgtctgcttttgagaatccatatgtagatgcaataaagagtttatggaatgatcctggaatccaggaatgctatgatagacgacgagaatatcaattatctgactctaccaaatactatcttaatgacttggaccgcgtagctgaccctgcctacctgcctacgcaacaagatgtgcttagagttcgagtccccaccacagggatcatcgaatacccctttgacttacaaagtgtc

SEQ ID NO: 13063 - DNA, 7490 bp, Homo sapiens
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggaccctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatatggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 13064 - DNA, 5919 bp, Homo sapiens
gttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcactcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 13065 - DNA, 7490 bp, Homo sapiens
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcactcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 13066 - DNA, 1093 bp, Homo sapiens
gcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggac

SEQ ID NO: 13067 - DNA, 7490 bp, Homo sapiens
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 13068 - DNA, 5977 bp, Homo sapiens
atggaggcagctgtggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggaccctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatatggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagag

SEQ ID NO: 13069 - DNA, 7490 bp, Homo sapiens; identical to SEQ ID NO: 13065

SEQ ID NO: 13070 - DNA, 1717 bp, Homo sapiens
attccacttccggaaggttgcggagaacatctgcggcggccgcattccggagccaactgcctccctccgtctctgccaggcatggcggcaacctcacaccttccctttgctgcgtttctataaatgctttgaaaaaattactcttttcttccctcgctggaaaacaccacaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggaccctagtagtgtcttgaagaagagtcggaggcgggggagaggatggactcgggccctggggccagagcagttgctgagagcctgtgaagccatcactgtggggaaaggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgt

SEQ ID NO: 13071 - DNA, 1093 bp, Homo sapiens
gcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggat

SEQ ID NO: 13072 - DNA, 1093 bp, Homo sapiens; identical to SEQ ID NO: 13066

SEQ ID NO: 13073 - DNA, 1093 bp, Homo sapiens; identical to SEQ ID NO: 13071

SEQ ID NO: 13074 - DNA, 7490 bp, Homo sapiens; identical to SEQ ID NO: 13063

SEQ ID NO: 13075 - DNA, 7490 bp, Homo sapiens
tgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcggggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagagacaacaaa

SEQ ID NO: 13076 - DNA, 1093 bp, Homo sapiens; identical to SEQ ID NO: 13066

SEQ ID NO: 13077 - DNA, 1093 bp, Homo sapiens; identical to SEQ ID NO: 13071

SEQ ID NO: 13078 - DNA, 7490 bp, Homo sapiens; identical to SEQ ID NO: 13063

SEQ ID NO: 13079 - DNA, 198 bp, Homo sapiens
gttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggat

SEQ ID NO: 13080 - DNA, 1094 bp, Homo sapiens
gcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatc

SEQ ID NO: 13081 - DNA, 1717 bp, Homo sapiens
attccacttccggaaggttgcggagaacatctgcggcggccgcattccggagccaactgcctccctccgtctctgccaggcatggcggcaacctcacaccttccctttgctgcgtttctataaatgctttgaaaaaattactcttttcttccctcgctggaaaacaccacaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaaggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgt

SEQ ID NO: 13082 - DNA, 1486 bp, Homo sapiens
gtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggg

SEQ ID NO: 13083 - DNA, 1486 bp, Homo sapiens
gtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcggggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggg

SEQ ID NO: 13084 - DNA, 5977 bp, Homo sapiens; identical to SEQ ID NO: 13068

SEQ ID NO: 13085 - DNA, 1717 bp, Homo sapiens; identical to SEQ ID NO: 13070

SEQ ID NO: 13086 - DNA, 1717 bp, Homo sapiens; identical to SEQ ID NO: 13081

SEQ ID NO: 13087 - DNA, 1486 bp, Homo sapiens; identical to SEQ ID NO: 13082

SEQ ID NO: 13088 - DNA, 5977 bp, Homo sapiens
atggaggcagctgtggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcggggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagag

SEQ ID NO: 13089 - DNA, 5977 bp, Homo sapiens
atggaggcagctgtggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcactcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagag

SEQ ID NO: 13090 - DNA, 1486 bp, Homo sapiens; identical to SEQ ID NO: 13082

SEQ ID NO: 13091 - DNA, 1717 bp, Homo sapiens; identical to SEQ ID NO: 13081

SEQ ID NO: 13092 - DNA, 5977 bp, Homo sapiens; identical to SEQ ID NO: 13089

SEQ ID NO: 13093 - DNA, 5977 bp, Homo sapiens
atggaggcagctgtggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaagatggaaagaagagaaatcgttttatgggttgctcaggagatagaattgacatgtcttgggattgttttgctgtgtaggggagagagacaagtcaagagtatacatcctgtttctgacttggcaactgggtgggtcatgggtctgtttcctgagacagttgtctacagccataccaccgtaagcgccctaaatctcatcagagacagtttatgcaaatggagcttggggaaagagaggtcgtggctggagacagagatttgggcatcatcaacatataggtgtggggagcagagaaggctgaggaagaaagcaggaaacatataaaaaggagagcagggaaaggagccagtgagacaggaaaaacctagtaacgtggtgtgatgaagctaggggaggaaggaaggaaggaagggcggcgtggaacgctgctgatgggtggtggcggggaaaatgaacgagtatccaccagcaacgagaggggcctccatggtcttggtgggagcatttctttggagaggtggaatcagaagccccagatgtcagagggttaaggaataatttggaggaaaagcgtaaaggcagtggaggtgaggagagaattttcaaaatgtttggcagtgattgcaatgaaagaaaaaaatggagggagcagagtatatgcagttgaggaacttttttagtttggagtgtgttaacacgatgttaggaagaaggatcaagtgaaggagaaaggtgaaaatgctggaaggtggggcttagtgatgaaacaaaccttggggacaggtgggcgtggtactgagagtcccagtgaggggagtgccctcaggcaggcgccggtggcttctgtcacaggagggaacagcgctgacattcagctggttcgcactgatacggctcaaccagtttgttaaaacatgtctgttccagtgtcagtaatatacgagtaactgcaatatgcagtaaaaattataaattctaatacaaactcagttcaagctaattaagagatcgcaacagccgttggtaaatggacttcccgctgcatttgagaagctttgcagcgccatctgccggtgtcgtagcatcactgcaggctgagaggctgctttgcgccttcatcttgaagcactctgaaattgcctgtttaaattaccttggaatcatggagttgctactgcttctgaatagtttagcttctactttgattttattgttagtgcattgtcgttcttgtgtcagtagcaagtttcagtgttttaatatttacaaatacaaaaatttttaataaaatattaaagccaaacttgaatgaagag

SEQ ID NO: 13094 - DNA, 1486 bp, Homo sapiens; identical to SEQ ID NO: 13082

SEQ ID NO: 13095 - DNA, 5977 bp, Homo sapiens; identical to SEQ ID NO: 13068

SEQ ID NO: 13096 - DNA, 1717 bp, Homo sapiens
attccacttccggaaggttgcggagaacatctgcggcggccgcattccggagccaactgcctccctccgtctctgccaggcatggcggcaacctcacaccttccctttgctgcgtttctataaatgctttgaaaaaattactcttttcttccctcgctggaaaacaccacaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaaggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcggggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgt

SEQ ID NO: 13097 - DNA, 1717 bp, Homo sapiens; identical to SEQ ID NO: 13070

SEQ ID NO: 13098 - DNA, 1486 bp, Homo sapiens; identical to SEQ ID NO: 13082

SEQ ID NO: 13099 - DNA, 2334 bp, Homo sapiens
gtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 13100 - DNA, 1676 bp, Homo sapiens
gtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaaaacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtggttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatga

SEQ ID NO: 13101 - DNA, 2041 bp, Homo sapiens
gctcgtcagtggcttcagttcacacgtggcgccagcggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 13102 - DNA, 2040 bp, Homo sapiens
gcggccgccaagcgatccctgctccgcgcgacactgcgtgcccgcgcacgcagagaggcggtgacgcactttacggcggcagcgtaagtgcgtgacgctcgtcagtggcttcagttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaagcgtgtgaaggcaaagaagaatgctgctccattcagaagtgaagtctgctttgggaaagagggcctttggaaacttcttggaggttttcaggaaacttgcagcaaagccattcgggttggagtaattggtttcccaaatgtggggaaaagcagcattatcaatagcttaaaacaagaacagatgtgtaatgttggtgtatccatggggcttacaaggagcatgcaagttgtccccttggacaaacagatcacaatcatagatagtccgagcttcatcgtatctccacttaattcctcctctgcgcttgctctgcgaagtccagcaagtattgaagtagtaaaaccgatggaggctgccagtgccatcctttcccaggctgatgctcgacaggtagtactgaaatatactgtcccaggctacaggaattctctggaattttttactgtgcttgctcagagaagaggtatgcaccaaaaaggtggaatcccaaatgttgaaggtgctgccaaactgctgtggtctgagtggacaggtgcctcattagcttactattgccatccccctacatcttggactcctcctccatattttaatgagagtattgtggtagacatgaaaagcggcttcaatctggaagaactggaaaagaacaatgcacagagcataagagccatcaagggccctcatttggccaatagcatccttttccagtcttccggtctgacaaatggaataatagaagaaaaggacatacatgaagaattgccaaaacggaaagaaaggaagcaggaggagagggaggatgacaaagacagtgaccaggaaactgttgatgaagaagttgatgaaaacagctcaggcatgtttgctgcagaagagacaggggaggcactgtctgaggagactacagcaggtgaacagtctacaaggtcttttatcttggataaaatcattgaagaggatgatgcttatgacttcagtacagattatgtgtaacagaacaatggctttttatgattttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattg

SEQ ID NO: 13103 - DNA, 567 bp, Homo sapiens
gctcttctacggctacggctttgtctctgctggtatgggggtgggagcctacgcgtaggccttggccctatttcctggtagaaccgagagttggaagtccctacggcgatcatgttaaccgcgcgggctcattctgcggaacgaagccgggcagagggtggggaagactaggctagattttcgtaaggaagcagcgtctgagccaggtttgaggcccaatattttctttccgtggccacgtgcagactggcccagagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaagg

SEQ ID NO: 13104 - DNA, 547 bp, Homo sapiens
gacaccagcagctgaatgattagaacaggagaacactggttgccagcagtatggaaagaaaggttggggatctccaggaaacagaaagaaggagcaaaagaatcacatttgaaaatcctgagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtgattgaagcctccgatgttgtcctagaggt

SEQ ID NO: 13105 - DNA, 729 bp, Homo sapiens
agttcacacgtggcgccagcggaggcaggttgatgtgtttgtgcttccttctacagccaatatgaaaaggcctaagttaaagaaagcaagtaaacgcatgacctgccataagcggtataaaatccaaaaaaaggttcgagaacatcatcgaaaattaagaaaggaggctaaaaagcggggtcacaagaagcctaggaaagacccaggagttccaaacagtgctccctttaaggaggctcttcttagggaagctgagctaaggaaacagaggcttgaagaactaaaacagcagcagaaacttgacaggcagaaggaactagaaaagaaaagaaaacttgaaactaatcctgatattaagccatcaaatgtggaacctatggaaaaggagtttgggctttgcaaaactgagaacaaagccaagtcgggcaaacagaattcaaagaagctgtactgccaagaacttaaaaaggtatcttagcctaggtgattgaagcctccgatgttgtcctagaggtgttggatgccagagatcctcttggttgcagatgtcctcaggtagaagaggccattgtccagagtggacagaaaaagctggtacttatattaaataaatcagatctggtaccaaaggagaatttggagagctggctaaattatttgaagaaagaattgccaacagtggtgttcagagcctcaacaaaaccaaaggataaagggaagataaccaag

SEQ ID NO: 13106 - DNA, 1515 bp, Homo sapiens
ccggcccacgccagctcccggccgcggcacagcagccccggcgctccccgcgccgccccgcgcaggcgcccccgccccgccgtcgccgccgccgcagccaggagccgctgcaccatgccccgcatagatgcggacctcaagctcgacttcaaggatgtcctgctccgacctaagcggagcagcctcaagagccgagccgaggtggatcttgaacgcaccttcacgtttcgaaattcaaagcagacctactcagggattcccatcatcgtggccaacatggacactgtgggcacgtttgagatggcagccgtgatgtcacagcactccatgtttacagcaattcataagcattactccctggatgactggaagctctttgccacaaatcacccagaatgcctgcagaatgtagccgtgagttcaggcagtgggcagaatgatctggaaaagatgaccagcatcctggaagctgtgccacaggttaagtttatttgcctggatgtggccaatgggtattcagaacattttgtggaattcgtgaaacttgtccgtgccaaatttcctgaacacaccattatggcagggaacgtggtgacaggagaaatggtagaagagcttattctttccggagcagatatcatcaaagtgggagttggaccaggttctgtgtgcaccacccgcaccaagacgggagtggggtacccccagctgagtgccgtcattgagtgtgccgactctgcccatggcctgaagggccacatcatctctgatggaggctgtacgtgtccaggggatgtcgccaaagcctttggagctggagcagattttgtcatgctgggaggaatgttttcgggtcatacggagtgtgctggagaagtgtttgagaggaacggacggaagctcaagctcttctacgggatgagctctgacaccgccatgaacaagcacgcaggaggagttgctgagtacagagcctctgagggtaagactgtggaagttccttacaaaggagatgtggaaaacactatcctggatattctcgggggactgaggtccacgtgcacctacgtgggggccgccaaactcaaggagctcagcaggagggcaacattcatccgggtgacccagcagcacaacaccgtgttcagctaaccctggggacaaagcagcgtctggctcgagtggaagcgtccaaacctgcttttcccatctccccccaagtctgttccgtcagagcttctggctgctcctgaatggtggaatgctgtgtcctctcttctgtctcctgctgcctggaggcttcggggctctcccgcctgccttctcggggcccagacgcaaggcaccgattgggccaacatcagagccctgctgcccagaactcataacctcattgttcaaaccaacacttgcacctttctctttttctctttctctctccctttctttgtttttctttcttttttaaaagaagatggtttcactttaatataatgctattatcttaagacttaa

SEQ ID NO: 13107 - DNA, 2022 bp, Homo sapiens
atcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacaggtatgtgtggaggcccaggagcttagtaatagtatggaggcagaactcatggctgctgagagggggatggtacagttctcagagaagcatggtgaaccggggctcaatgctagggtctgtggaaaagtccctgggcttaaggaatccagaaggagaagataataaagtttttcctactttaagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgt

SEQ ID NO: 13108 - DNA, 1972 bp, Homo sapiens
aaaggctcagggttgctcccgcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgaggttagttgctaagcaaggtggtctttggtcaactgccgcctggaccaaggcaacaggaaccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 13109 - DNA, 1652 bp, Homo sapiens
agttatgaaccctccccgccccccgtcgccaacattccttcgttcccctaaatcagcctcttgccccattgctctttgcaggggtagaagaaggaagtgtagcgggccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 13110 - DNA, 1864 bp, Homo sapiens
caacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 13111 - DNA, 1855 bp, Homo sapiens
ggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagagcatctggctgccagctcaggcacaggctcttctgactttgagcagctggaacagatcctggaagctattccccaggaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgt

SEQ ID NO: 13112 - DNA, 1893 bp, Homo sapiens
gcgtttcggttcagtgacgtcgtaaattggaatgaggcatccagtttagcaacagcagagatgacgactctgcgattctgagagtccctggcgagcccgggctagcgaaaagtgggggcagaacgaactacatctcccatcgtgccaggaggcggtcccgcccgtttccccctgggagttgtagtctaaccccctcggatccaacagcaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaa

SEQ ID NO: 13113 - DNA, 3035 bp, Homo sapiens
ggagtcagtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccgttagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaactcttaacactcatacttgaaaactttctgagtttccccagaagagaatatgggattttttttgacatttttgactcatttaataatgctcttgtgtttacctagtatatgtagactttgtcttatgtgtgaaaagtcctaggaaagtggttgatgtttcttatagcaattaaaaattatttttgaactgaaaa

SEQ ID NO: 13114 - DNA, 1845 bp, Homo sapiens
atcaatgaggaaatcccagccctacaacttcggaacagtgaaatattagtccagggatccagtgagagacacagaagtgctagaagccagtgctcgtgaactaaggagaaaaagaacagacaagggaacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaa

SEQ ID NO: 13115 - DNA, 2220 bp, Homo sapiens
atattagtgcatttctttgcagaggttacctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 13116 - DNA, 3687 bp, Homo sapiens
gttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggtctctgacattgacagagcctggacgttggaggaagccccaggacgttggaggggtaaagtaaaagtccacagttaccgtgagagaaaaaagagggagaaagcagtgcagccaaactcggaagaaaagagaggaggaaaaggactcgactttcacattggaacaaccttctttccagtgctaaaggatctctgatctggggaacaacaccctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattccagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttgcacaccgatgctccagaattgtgagggagccatactctacagctattccaccgaggataatactaccattgtaaaggcatctcacgggaaaacaacacagctaccatgaaccagcaccatgatctctggatgaaatgctggaagcttctgcagtgtcagctatgagtaaatggatgccaccaccttcacattttcagtaaacaaatactcccctaccccatgaaaagttgcatctttgagctgctcacatctccagctaagcctcacaaaagtcaatctgcagggaagaatctaaatcatatgcctacccatgggaaagtctgagaattagagtatttttgtcttctacttttggaggaagaaactaataacgtgggaaattttcctgtatgtttagtcaaccagtttttccatgcagatgtatggagataaatcttatagtaggaataacctaagacttgagttagtatttttgtgtacatcagatacaacactcttctcatcttttttgtcattatttttcaatgttgttttaatctttccactgttgtttcatgtcatgcactttgttaatattctttaagttattcttagtttttaacaatgatacttaagaaagacttaataggactatagaataggtactccctattccccaaccctgggaacacaatttaacatattagttcatttgtatttaagatctatcttgtttatgcctcagtttagttattgctcttacctttcaaacagttagtattttgtatctagttctgtgaaagcaaaaagcaactttattctttcttacaattccccttttacttaatcggaacatttctttcctgtttgttcattagtcactctcagataaatgaatagtctctttttctaaaaaaaaaaataacatttgacctaaa

SEQ ID NO: 13117 - DNA, 1498 bp, Homo sapiens
attacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacc

SEQ ID NO: 13118 - DNA, 3037 bp, Homo sapiens
actttcagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaccagtcaaaaagataaaaattttaatctgccccgactctgtatccggaagttcttcccaaagaaaaaatgttttgtcttcgatctgcccattcaccgcaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaa

SEQ ID NO: 13119 - DNA, 2939 bp, Homo sapiens
cagtttcattaggctctgaagccattacaaaggttgcttaacttctaattatttgatcactgaggaaaatccagaaagctacacaacactgaaggggtgaaataaaagtccagcgatccagcgaaagaaaagagaagtgacagaaacaactttacctggactgaagataaaagcacagacaagagaacaatgccctggacatggctccagagatccacatgacaggcccaatgtgcctcattgagaacactaatggggaactggtggcgaatccagaagctctgaaaatcctgtctgccattacacagcctgtggtggtggtggcaattgtgggcctctaccgcacaggaaaatcctacctgatgaacaagctagctgggaagaataagggcttctctctgggctccacagtgaaatctcacaccaaaggaatctggatgtggtgtgtgcctcaccccaaaaagccagaacacaccttagtcctgcttgacactgagggcctgggagatgtaaagaagggtgacaaccagaatgactcctggatcttcaccctggccgtcctcctgagcagcactctcgtgtacaatagcatgggaaccatcaaccagcaggctatggaccaactgtactatgtgacagagctgacacatcgaatccgatcaaaatcctcacctgatgagaatgagaatgaggattcagctgactttgtgagcttcttcccagattttgtgtggacactgagagatttctccctggacttggaagcagatggacaacccctcacaccagatgagtacctggagtattccctgaagctaacgcaaggtaacaggaagcttgcccagcttgagaaactacaagatgaagagctggaccctgaatttgtgcaacaagtagcagacttctgttcctacatctttagcaattccaaaactaaaactctttcaggaggcatcaaggtcaatgggcctcgtctagagagcctagtgctgacctatatcaatgctatcagcagaggggatctgccctgcatggagaacgcagtcctggccttggcccagatagagaactcagccgcagtgcaaaaggctattgcccactatgaccagcagatgggccagaaggtgcagctgcccgcagaaaccctccaggagctgctggacctgcacagggttagtgagagggaggccactgaagtctatatgaagaactctttcaaggatgtggaccatctgtttcaaaagaaattagcggcccagctagacaaaaagcgggatgacttttgtaaacagaatcaagaagcatcatcagatcgttgctcagctttacttcaggtcattttcagtcctctagaagaagaagtgaaggcgggaatttattcgaaaccagggggctattgtctctttattcagaagctacaagacctggagaaaaagtactatgaggaaccaaggaaggggatacaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggaacaggcccgagtactaaaggagagatgccaaggtgaaagtacccaacttcaaaatgagatacaaaagctacagaagaccctgaaaaaaaaaaccaagagatatatgtcgcataagctaaagatctaaacaacagagcttttctgtcatcctaacccaaggcataactgaaacaattttagaatttggaacaagtgtcactatatttgataataattagatcttgcatcataacactaaaagtttacaagaacatgcagttcaatgatcaaaatcatgttttttccttaaaaagattgtaaattgtgcaacaaagatgcatttacctctgtaccaacagaggagggatcatgagttgccaccactcagaagtttattcttccagacgaccagtggatactgaggaaagtcttaggtaaaaatcttgggacatatttgggcactggtttggccaagtgtacaatgggtcccaatatcagaaacaaccatcctagcttcctagggaagacagtgtacagttctccattatatcaaggctacaaggtctatgagcaataatgtgatttctggacattgcccatggataattctcactgatggatctcaagctaaagcaaaccatcttatacagagatctagaatcttatattttccataggaaggtaaagaaatcattagcaagagtaggaattgaatcataaacaaattggctaatgaagaaatcttttctttcttgttcaattcatctagattataaccttaatgtgacacctgagacctttagacagttgaccctgaattaaatagtcacatggtaacaattatgcactgtgtaattttagtaatgtataacatgcaatgatgcactttaactgaagatagagactatgttagaaaattgaactaatttaattatttgattgttttaatcctaaagcataagttagtcttttcctgattcttaaaggtcatacttgaaatcctgccaattttccccaaagggaatatggaatttttttgactttcttttgagcaataaaataattgtcttgccattacttagtatatgtagacttcatcccaattgtcaaacatcctaggtaagtggttgacatttcttacagcaattacagattatttttgaactagaaataaactaaactagaaataaaataa

SEQ ID NO: 13120 - DNA, 411 bp, Homo sapiens
caagatgaagagctggaccctgaatttgtgcaacaagtagcagacttctgttcctacatctttagcaattccaaaactaaaactctttcaggaggcatcaaggctgaagagattctgcagacatacttgaaatccaaggagtctgtgaccgatgcaattctacagacagaccagattctcacagaaaaggaaaaggagattgaagtggaatgtgtaaaagctgaatctgcacaggcttcagcaaaaatggtggaggaaatgcaaataaagtatcagcagatgatggaagagaaagagaagagttatcaagaacatgtgaaacaattgactgagaagatggagagggagagggcccagttgctggaagagcaagagaagaccctcactagtaaacttcaggtatccaaatgc

SEQ ID NO: 13121 - DNA, 6127 bp, Homo sapiens
ctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccaggtaagaaaatataaaatgaggtttattttattttaataacataacactgttgctcattttgtaagtatatgtgttatagcagtttcattcaagaaaagtttaaaattaaaaagtgattatcaaagaatatcagggcctgacatccacaaaaaacaaacttaattttgattgaactaataatttataaacatgggaaacaagtcagaagtagtgacattattcctagaaaagatttaaggaaagcaaaaagacaactggtaagattaagaagccattaaccatttgcaatttatattatagtcacagaaataatttcagttatgactagctcttgccgattaatgagaagagagcagctccacaatttttaatttttttaacttttattttagattcaggggtatatgtgcaggtttgttacataggtaaactgcatgtcatgggggtttggtgtgcagataattttatcacacaattattaatcataatacccaataggtttttttctgatcttctccctcctcccaacctacaccctcaagtagaccccagtgtctcttgttctcctctgagtatccatgtgttctctttgtttggcccccatttataagtgagaacatgtggtatttgggtttctgttcctgtgttagtttgcttatgataatggcttccagctccatccatattgctacagaggacatgatcttgttgttttttatggctgcatagtattccatggtgtttgtatataccacattttcattatccagcctattattaatgcacatttaggttgattccttatctttgctattgtgaacagtgctgcaatggacatacacgtgcatgtgcctttatggtacaatgatttatatttccttgggatatgcattcctttgggaataatgggattgctgagttgaatggtaattctgagttctttgaggaatcaccaacctgctttccacagtggctaaactaatttacactcccaccaacagtgtatgtgttccattttctccacaaccttgccagcatctgttatttattgactttctagtaacagccattctgactggtgtgagatggtatgcatttctgtagtgattagtgatgatgagtgatttttatatgctttttaaatgcatatatgtcttcttttgaaatgtgttcatgttctttgcccactttctttttaatggggttgcttgtttttcgcttgtaaattttttgaagcttcttatagattctggatattagatctttgttggatgcatagttggcaaatattttctaccattctgtaggttgtctgttactttgttaattgtttcattttgttttgtttttgttttttgaaacagggtctcactttgacacccaggctggagtgcagtagcacaaacatgggtcattgtagcctcaacctcccaggctcaagcagtcctttcacctcaaccccccacatagctgggactacaggtgcttacacccaagaccagttaattttttgtatttgtttgtagagatgtgtttttccatgttgcccaagctggtcttgaactactgagctcaagcaatctgcctgcttcagcctcccaaagtactgggatttaggcatgagccaccacatctggccaatagtttcttttgatgtgcagaagctctttaatttaattagatctcctttgtcagtttttgtttttgctgcaattgcttatgttatcttcatcatgaaattttagccaagtcttatgtccagaatggtatttcttaggttatttttcagagtttttatagtttaatgttttatatttaagtctttaatccttcttaagttgatttttgtatgcagagtaagctgggggcccagtttcaatcttctgcatatggctagccagtaatcccagcaccatttattaaatggggacttctttccccattgcttgtttttgtcagctttgtccaagatcagatgattgtaggtgtacagcattatttctggactctctgttatgttccatttatctgtgtgtctgtttttctactaataccatgctgttttggttactgtagctctgtagtatggtttgaggtttggtaacttgatgcctccccttttgttctttatgtttaggattgccttggctaggctcttttttggttccatatgaattttaaagtagtttctaattctgtgaagaatgtcattggtagtttgatagggatagcattgaactatttgctcaactcaacattttaggaatttatttctgctgtctagtgctcaaaacttgcagctagaattgagggaagagagagaccttcttatattgttttatattgtttgatactcagtacctgttttaagaaaaaacaacaaggaagtaaaaccaaagacaggcagcccagcgccaggcccaaaaccaggcctgggcctgcctggcctaaacccagtagttaaaaatcaactcattgcctgtaatcccagcactttgggaggccgagacgggtggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccaggaggcggagcttgcagtgagtcgagatcgcgccactgcactccagcctgggcgacagagcgaaactccgtctcaaaaaaaaaaaaaaaaaatcaactcataacttagaaaccgatgttattcatagattccagacattgtatagaagaacatttggaaactcactgccttgttctgtttctctctgaccaccagtgcatgcagcccctgtcatgtaccgcctgtttgctcaaatcaatcatgaccctttcatgtgaaatctttagtgttgtgagcccttaaaagggacagaaattgtgcattcaaggagcttggattttaaggcagcagcttgctgatgccaccagctgaaaaaagcccttccttctccaactcggtgtctgagaagttttgtctgcagctcatcctgctacagaatgaactccttgtaattctacaagatatgccatgggccttttcacaggggacacaggcttcttaaaacaacccggcttcctcaccctatgtcctttatttacaaagctgtgctcctattcatgagcatggaatgtttttccatttgtttgtgacatctcttatttctttcaggggtatcttgtaattctcattatatatatcttttgcttccttggttagctgtatttttaggtattttagtcttcttgtggcaattgtgaatgggattgcattcctgatttggctcttggcttaatgttattaacgccacattttttaaatagacaaaaatatgagattaaaaatgttgaattttactaacaataaaagttgttcaaaggaaaactataaggttcttgtttcaactctgtcataggaagaacaggacagtgagctggcacagagttagggaaactgactgtgtctcatattggctagtgagagtgatctgttggaattgtatatcaaaattttaatgtacatacattttgtctagcaattctactattgggtatttatatagtacatataaatataaatgtatatgtttagtaaatatatacttatagttagtaaatatattttatatctatttagtaaatatactaaatgtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcaca

SEQ ID NO: 13122 - DNA, 4047 bp, Homo sapiens
cactgaggtcaccctccaggctgtggaacctttgttctttcactctttgcaataaatcttgctgctgctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacactcaacgctagggtccgcggcttcattcttgaagtcagtgagaccaagaacccaccaattccggacacgctaattgttgtagatcatcacttcaaggtgcccatatctttctagtggaaaaattattctggcctccgctgcatacaaatcaggcaaccagaattctacatatataaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaactttcatatagagttataagattatgatgctggtatctggtaaaatgtacatcccagtagtccaatagtttaaatgtttattgcttcctttaagagattataaattgtataagggacattgtatcactgccttcatttatgcgtgatattgggatggtttcatcaggagatgctttccttgcatctcaatgtcatctgtctaatttctcataaggggattatgttacctagagcagggcttcccaaccctcaggccatagactagctctgatctgtggcctcttaggaacccggccacacagcaggaggtgagcagcaggtaagtgagcattacagcctgagctccacctcctgtcagatcagcagtgacattagattctcacaggagtgggaaccctattgtgaactgtgcatgcaaaagatctaggttgtgtgatccttgtggaacaatataaaccagaaaccaataacgccaccccacctccaacccccgccaaccctctgtggaaaaattaccttccacgaaactggtccctgatgccaaataggttgggggaccgctgacctagagggagttatgcacatgggcttataaggttagccaagagaaaggacaagaagacccaaagtcggcaagcaaatttattaacctgctgggctgctctacagaaatctgaggaggcagacaccgggcttacaggctaaggggtataagtaggtctgcaggggttttgtgtgtgtgtgcgggggtgtcgggggggcaaggccatttgtggagacttttcctcccagtatggccacatcctgcagtttgtcagtttttgcccccgcctggctcagggtaccaggatgtggtttagcttaggggtggttatagtggcacctaagttctgggaacttgcggtgggggcgaccttttggacgaaaaataagctgcagggcagctaggggagggggcttgttatattcctctgggggcagggtgtccctaactgggctcagtcggaaggaacttgaccaaagtctgggctcagttgggcatcactcaggctaatggtcgtgtgctggatgccatcagagggaagtaccaatggtaaagtggaaacaatgtgcagctttcaactgggtggaggctgctattctgtggacagtgagatgtttccttggcactgtcaatagacaatctgcgtagagaaattccaagctgaaagccaataatgttataataaaatagagattcttcagaagatgaaaggaattaccagcatggaaattgtgtcataggcttaagggctaaagaagaagccttttcttttctgttcaccctcaccaagagcacaacttaaatagggcattttataacctgaacacaatttatattggacttaattattatgtgtaatatgtttataatcctttagatcttataaatatgtggtataaggaatgccatataatgtgccaaaaatctgagtgcatttaatttaatgcttgcttatagtgctaaagttaaatgatcttaattctttgcaattatatatgaaaaatgactgatttttcttaaaatatgtaacttatataaatatatctgtttgtacagattttaaccataaaaacatttttggaaaacc

SEQ ID NO: 13123 - DNA, 2011 bp, Homo sapiens
gctaattgttgtagatcatcacttcaaggtgcccatatctttctagtggaaaaattattctggcctccgctgcatacaaatcaggcaaccagaattctacatatataaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacggaaaaaaagaagaaagaggcacaagtgaaagcagaagctgaaaaggctgaagcgcaaaggttggcggcgattcaaaggcagaacgagcaaatgatgcaggagagggagagactccatcaggaacaagtgagacaaatggagatagccaaacaaaattggctggcagagcaacagaaaatgcaggaacaacagatgcaggaacaggctgcacagctcagcacaacattccaagctcaaaatagaagccttctcagtgagctccagcacgcccagaggactgttaataacgatgatccatgtgttttactctaaagtgctaaatatgggagtttcctttttttactctttgtcactgatgacacaacagaaaagaaactgtagaccttgggacaatcaacatttaaataaactttataattattttttcaaacttt

SEQ ID NO: 13124 - DNA, 4699 bp, Homo sapiens
cttgctgctgctcactctttgggtccacactgcctttatgagctgtaacactcactgggaatgtctgcagcttcactcctgaagccagcgagaccacgaacccaccaggaggaacaaacaactccagacgcgcagccttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacactcaacgctagggtccgcggcttcattcttgaagtcagtgagaccaagaacccaccaattccggacacggtaagactggggcaagaggtggaagagatttgcaagattcatttggttttagaaacattctacaaaggataggatgcagcttatcctgatgtggtatatcagacctcagtaaagaataaattgtattcttatcagacaggcagcagaattcatcaagtaccagctgtgtctgcctcttgctgaattagacatcaatgtgtgtggtgactaaactaagagtttgaaatgccttcaaattatttttcttcctttgcaattttatgacttattcaggatcataatttccacttaagttaccttcgtccttcataaaatctgattaaactgactcgaacttcagcatgaaagtttcaaaaactatgatagctattattttcatgagaaagaacaatgaatatgatgcaatgtaagtagcttgcaaacattaaggacaagaaaaaaatgttgcccagagagaagtttcatgaaaacagtgatgtatttttagtcatagtcttgtactttgtttgaaagtagatttcttcctttagcaatagccctgacttaattcatgttggtttcttggcatctactcacttaactaaccccttttgtgttgggttctgcttctactactctattgcctttactattatgaatcacctaatttaacagttgcccaactggatccctcaatactgtctggcaactgttcactcgttgaaattctctcctttgaatttcttaccatgacacatacttcaagcattttgtactagtttgatttccatttatatccttaataagagccttttccttttccttgaaattcaaaccagaaactatgcaaaataagcaaaagcaagcaataacaactacatatacaaatgcaggcgcaaaacccaaactagaatcatatggctgaaaacagatgttttctttcagaaatccttccactaccacttctgagcattttctcttagtatttttttttgggcattttccttctttgcactttttaaaatctcctgcagctcgctcactctctttcataagccagcagttatactgatgttaataaatagttgtttatttacttttgcttttttagaaaacaagctgaaagaattgagtgaaatgccagagagatacagatagccagttgtagggctggggttggaaatcaagtctaatttaaggcaagggcaaaatgtgcattttgtgtgtgtattttgaaccattcttgcattgtttttatttgcaaaggttatagggctcaagcagttagggagaatgcatcccagaacactaagttatgaataacagagcaacagttatgtttgtggcttgaacacattaaatctgcaataatgttttagaaatttggctttactaaaagcattaaagatgctatccagatgacattggggacaacatgtcaaatactattattaatgtagatatacaatgctattgtcattcataagagagtctgaacactcagacacattcattccctcttccttagtgacatcatcccaaatcataagatcttgtaagctctcaatatctgcttatagatttggcttatgtatcttttgtttttctagctaattgttgtagatcatcacttcaaggtgcccatatctttctagtggaaaaattattctggcctccgctgcatacaaatcaggcaaccagaattctacatatataaggtactaatactacattgaaaatagattagaatgagaagagacctgccatttgagtctctaaatttgttgcaaaattgcctctttctgggtcaggcttgcactaggcatttcctgactcccatgtcctagtgctacaccatttgcaaatggatatcctattttctgctgccaagcagtttctgttttaatttatgtcaacataatgatttccagggcattagctatgaggaagcagggagaatgggtcttcataattgtaaaatgacagtttttgaaatttgctagtaaagagatggagaatccaaaccttttcattgtaagattttagtgaaagaactcgtcaagcggatagtgaagttttagcatccttagtaaataaccacctttaaaatggaagaaaactatcctttatgataaggcaaagtagaaaagcatatttttatggcatttgctttttctcatatagctcaaacattttttttaaccagagactctttaggttatagggattgatgctcagaagttagaaaaaaataggttaagtattattaaaggaagttgttttactcattcagtcaatcataaaataatcatgctttgaagttttggtttaataaagcacattagtaactatgtaaaaaatttcaagtatatcactaagaagcaaacagctatgatttgttagataatgctgcataatgacttggtagtatttaatgtaatgcagtttgactggacatagatctaactgaaaaaaatgaagttgacacaaagtaaaaggaacagtgtaatatattaataaagaacatcataaagaattaatataggaacccagggaggtaaaaactaaaaaacataactaagccaaaaaccaatggaataagagttagattcaaactagtaggttagacgcaggaaatggattttcgtatgcctatcaaatatttaagaaccagtagaatggcctatagtagacatataaagggcctaggacttacttttgttttaaaataaagtctctctattttacaggactctttttattttaaaactttttttttccagaaacttaggcagtgctggggagtagtatgtccccaggttcagtaagcaaaatgacttcctttgcttattaaacaaacaccagaaattccagcctatcccatctgttcccttgcaggcaaagtaacatcctagacatggctttagagatccacatgtcagaccccatgtgcctcatcgagaactttaatgagcagctgaaggttaatcaggaagctttggagatcctgtctgccattacgcaacctgtagttgtggtagcgattgtgggcctctatcgcactggcaaatcctacctgatgaacaagctggctgggaagaacaagggcttctctgttgcatctacggtgcagtctcacaccaagggaatttggatatggtgtgtgcctcatcccaactggccaaatcacacattagttctgcttgacaccgagggcctgggagatgtagagaaggctgacaacaagaatgatatccagatctttgcactggcactcttactgagcagcacctttgtgtacaatactgtgaacaaaattgatcagggtgctatcgacctactgcacaatgtgacagaactgacagatctgctcaaggcaagaaactcacccgaccttgacagggttgaagatcctgctgactctgcgagcttcttcccagacttagtgtggactctgagagatttctgcttaggcctggaaatagatgggcaacttgtcacaccagatgaatacctggagaattccctaaggccaaagcaaggtagtgatcaaagagttcaaaatttcaatttgccccgtctgtgtatacagaagttctttccaaaaaagaaatgctttatctttgacttacctgctcaccaaaaaaagcttgcccaacttgaaacactgcctgatgatgagctagagcctgaatttgtgcaacaagtgacagaattctgttcctacatctttagccattctatgaccaagactcttccaggtggcatcatggtcaatggatctcgtctaaagaacctggtgctgacctatgtcaatgccatcagcagtggggatctgccttgcatagagaatgcagtcctggccttggctcagagagagaactcagctgcagtgcaaaaggccattgcccactatgaccagcaaatgggccagaaagtgcagctgcccatggaaaccctccaggagctgctggacctgcacaggaccagtgagagggaggccattgaagtcttcatgaaaaactctttcaaggatgtagaccaaagtttccagaaagaattggagactctactagatgcaaaacagaatgacatttgtaaacggaacctggaagcatcctcggattattgctcggctttacttaaggatatttttggtcctctagaagaagcagtgaagcagggaatttattctaagccaggaggccataatctcttcattcagaaaacagaagaactgaaggcaaagtactatcgggagcctcggaaaggaatacaggctgaagaagttctgcagaaatatttaaagtccaaggagtctgtgagtcatgcaatattacagactgaccaggctctcacagagacgg

SEQ ID NO: 13125 - DNA, 2454 bp, Homo sapiens
aagaaaaaaagtgggagaaatcagtgcagccaaattcagaactaaagagaagagaataaagactcataactttctcattgaagctgccttcttaccaagtccagaggatctctactctggacagaggaacgccctgaacatggcatcagagatccacatgccaggcccagtgtgcctcactgagaacactaaagggcatctggtggtgaattcagaagctctggaaatcctgtctgccattacacagcctgtagtagtggtggcaattgtgggcctctaccgcacaggcaaatcctacctaatgaacaagctggctgggaagaacaaaggcttccctctgggctgcacagtgaagtctgaaaccaaaggcatctggatgtggtgtgtgccccacccctccaagccaaaccacaccctgatccttctggacacggagggcctgggtgatatggaaaagagtgaccctaagagtgactcgtggatctttgccctggctgtgcttctaagcagcagctttgtctacaacagcatgggcaccatcaaccaccaggccctggagcagctgcactacgtgactgagctaacagagctaatcagggcaaaatcgtgccccagacctgatgaagttgaggactccagcgagtttgtgagtttctttccagactttatttggactgttcgagattttaccctggagctgaagttagatggacaccccatcacagaagatgagtacctggagaatgccttgaagctgatttcaggcaagaatccccaaatccaaaattctaacaagcccagggagtggatcaggcatttctttccaaaacagaagtgctttgtctttgaccggccaataaatgacaaaaaactcttactccatgttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggcagacgaggtcctccagagcttcctgcagtcacaggtggttatagaggaatccatcctgcagtcagacaaagccctcactgctggagagaaggccatagcagctaagcaggctaagaaggaggcagctgaaaaggaacaggagctgctaagacaaaaacagaaggaacagcagcaaatgatggaggctcaagagagaagtttccaggaaaacatagctcaactcaagaagaagatggagagggaaagggaaaactatatgagagaactgagaaagatgttgagtcacaagatgaaggtcctagaagaactgcttactgaaggatttaaagagatatttgagtcgttaaatgaagagattaatcgactgaaagaacaaattgaagcagctgaaaatgaagagccctcagtgttttcacagattcttgatgtggctggcagtatatttattgcagcactacctggggctgctaagctagttgatttaggaatgaaaattcttagctcattatgtaataggctgagaaatcctggtaagaaaattataagctgaggtttcttttgttaaaatggtataacgctgttgctcattttaaaagtatatgtgttattgcagtttcatttaagaaaagtttaaaattaaaaagcaaatttcaaagaatattatggcctgaagttcataaaaacaaacttaattttgactaaagtaataattaatagaaatggggaacaagttagaagataaaattattcctagaaaagatttaagtaaagcaaaaggacaaatggtaatataaagaaattattttcaattaatgttatagtcacagagataatttaagttataattagctcttgcaaatcagtgagaagagagtaacgccacatattttaaacaggcaaaaatatgataataaaaatgtttaattttactgacaataaaagttgtgc

SEQ ID NO: 13126 - DNA, 2987 bp, Homo sapiens
ggaggaaagaaaacaagaggtgagtgaggcaactgaaaactgttcttggacctgcggtgctatagagcaggctcttctaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctgggctccacggtgcagtctgaaaccaagggcatctggatgtggtgcgtgccccacccatccaagccaaaccacaccctggtccttctggacaccgaaggtctgggcgatgtggaaaagggtgaccctaagaatgactcctggatctttgccctggctgtgctcctgtgcagcacctttgtctacaacagcatgagcaccatcaaccaccaggccctggagcagctgcattatgtgacggagctcacagaactaattaaggcaaagtcctccccaaggcctgatggagtagaagattccacagagtttgtgagtttcttcccagactttctttggacagtacgggatttcactctggagctgaagttgaacggtcaccctatcacagaagatgaatacctggagaatgccttgaagctgattcaaggcaataatcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaccaagaccctcagggagggaatcacagtcactgggaatcgtctgggaactctggcagtgacttatgtagaggccatcaacagtggagcagtgccttgtctggagaatgcagtgataactctggcccagcgtgagaactcagcggccgtgcagagggcagctgactactacagccagcagatggcccagcgagtgaagctccccacagacacgctccaggagctgctggacatgcatgcggcctgtgagagggaagccattgcaatcttcatggagcactccttcaaggatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagataagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagttttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggccaggctggtctcgaactcttgacctcaaatgatccacccgcctcggcctcccaaagtgctgggtttacaggcatgagccaccatgcccagccctcatttagcaaagttttaaacataaaaagtgcttattagaggatatcagtgcctggcccacatgagagaacagatccatacacactttgaaaaactttgttcacttttaggaaatataattttgaaaaatcatttacatacaagaggtccactgaggcattgcttttaatggcaaaatattgcaatgtacttgaatgtccttcacattagattggtaagataaattttagtatgtgcatgtactggaatattatatagccagtaaacaaattgacaatgaagctctatttgtaccagtaaagaatggtcttgaagagacattgtaaaatgaaaaaaaaaaaaaccaagttgtaaagcaatgtagattatcttatcagcatggaaaaaatgcaattattatatggaagcatgcaaatatatctctggaaagattaatcaaaatctattattattggctccttctgggaagaaccaagtgaatgtaggggttgaaggaacacatactcttcactttatactcttgaattttgtaaagaaatcttattttaccgattcagaaataaataagaaaatgtaagagacaatgctaataatgataacaataaaaaaatagtgaaattggctatca

SEQ ID NO: 13127 - DNA, 2070 bp, Homo sapiens
aggaaagaaaacaagaggtgagtgaggcaactgaaaactgttcttggacctgcggtgctatagagcagggtgaccctaagaatgactcctggatctttgccctggctgtgctcctgtgcagcacctttgtctacaacagcatgagcaccatcaaccaccaggccctggagcagctgcattatgtgacggagctcacagaactaattaaggcaaagtcctccccaaggcctgatggagtagaagattccacagagtttgtgagtttcttcccagactttctttggacagtacgggatttcactctggagctgaagttgaacggtcaccctatcacagaagatgaatacctggagaatgccttgaagctgattcaaggcaataatcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaccaagaccctcagggagggaatcacagtcactgggaatcgtctgggaactctggcagtgacttatgtagaggccatcaacagtggagcagtgccttgtctggagaatgcagtgataactctggcccagcgtgagaactcagcggccgtgcagagggcagctgactactacagccagcagatggcccagcgagtgaagctccccacagacacgctccaggagctgctggacatgcatgcggcctgtgagagggaagccattgcaatcttcatggagcactccttcaaggatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagataagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagttttttttttttttcagagtcttactctgttgcccaggctggagtacagtggtgcaatctcagctcactgcaacctctgcctcctgggttcaagagattcacctgcctcagccccctagtagctgggattataggtgtacaccaccacacccagctaatttttgtatttttagtagagatggggtttcactatgttggccaggctggtctcgaactcttgacctcaaatgatccacccgcctcggcctcccaaagtgctgggtttacaggcatgagccaccatgcccagccctcatttagcaaagttttaaacataaaaagtgcttattagaggatatcagtgcct

SEQ ID NO: 13128 - DNA, 2024 bp, Homo sapiens
agaaaagtaaaaggaggaaagaaaacaagaggtgagtgaggcaactgaaaactgttcttggacctgcggtgctatagagcaggctcttctaggttggcagttgccatggaatctggacccaaaatgttggcccccgtttgcctggtggaaaataacaatgagcagctattggtgaaccagcaagctatacagattcttgaaaagatttctcagccagtggtggtggtggccattgtaggactgtaccgtacagggaaatcctacttgatgaaccatctggcaggacagaatcatggcttccctctggacaccgaaggtctgggcgatgtggaaaagggtgaccctaagaatgactcctggatctttgccctggctgtgctcctgtgcagcacctttgtctacaacagcatgagcaccatcaaccaccaggccctggagcagctgcattatgtgacggagctcacagaactaattaaggcaaagtcctccccaaggcctgatggagtagaagattccacagagtttgtgagtttcttcccagactttctttggacagtacgggatttcactctggagctgaagttgaacggtcaccctatcacagaagatgaatacctggagaatgccttgaagctgattcaaggcaataatcccagagttcaaacatccaattttcccagggagtgcatcaggcgtttctttccaaaacggaagtgtttcgtctttgaccggccaacaaatgacaaagaccttctagccaatattgagaaggtgtcagaaaagcaactggatcccaaattccaggaacaaacaaacattttctgttcttacatcttcactcatgcaagaaccaagaccctcagggagggaatcacagtcactgggaatcgtctgggaactctggcagtgacttatgtagaggccatcaacagtggagcagtgccttgtctggagaatgcagtgataactctggcccagcgtgagaactcagcggccgtgcagagggcagctgactactacagccagcagatggcccagcgagtgaagctccccacagacacgctccaggagctgctggacatgcatgcggcctgtgagagggaagccattgcaatcttcatggagcactccttcaaggatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagataagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctttggactatttttgatctgtatgtttttcattttcattcagcaagttttttttttttttcagagtcttactctgttg

SEQ ID NO: 13129 - DNA, 4286 bp, Homo sapiens
ggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaagtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaa

SEQ ID NO: 13130 - DNA, 2552 bp, Homo sapiens
acacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttaca

SEQ ID NO: 13131 - DNA, 3047 bp, Homo sapiens
tgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagccccagaggagtgaactccttttctcctttcctgtttccatccagctggttccagatcagcatcaaagtgaaacggatttgggtactgaaaagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagcc

SEQ ID NO: 13132 - DNA, 5795 bp, Homo sapiens
gaggcgggagcagagagggaaagggggcgagataggcgcgcaggcggcagaagcctctgcctctgcctccccttctgcttgggccgcagccctccccgccccgccgaccgcggtcacacactctcggagcctccccgtgagcgggagcgcggcgcacggcgatgcgccgaggcgggcgctgaggcggcgccgcgcgagcagcagcagaggcggcggcggcccccagcccagcccggcgccgccgccgagcccgggccccaaggtgcggcggcgccccaagttcccgccatgagcagccggctcggggggctccgcggccccggggactcccgccccgccgggcgcgaccgcagcgccccgcggccccgacgcgcttaacgttgtcgcttgccggtcccgccaccgccgcctccgccgccgctcgcgtcctcgccgccaccgcctcggccgctgcagctccgccggcagcatgtctcgaaggaagatttcgtccgagtccttcagctccctgggctccgactacctggagaccagcccggaggaggagggggagtgccccctgtctaggctctgctggaatggcagccggagcccgcccgggccgctggagcccagcccggccgcagctgccgctgccgccgccccggccccgaccccggctgcttctgccgccgccgccgctgccactgccggggccaggagggtgcagcgccggaggcgggtcaacctggactcgctgggcgagagcatcagccgcctgacggcgccctcgcctcagacgatacagcagactctcaagaggacactgcagtattatgaacatcaagttattggttacagggatgcagaaaagaatttccacaatatctctaacagatgctcctatgcagaccactccaacaaagaagaaattgaagatgtctcaggaattcttcagtgtactgctaatatactcggtttgaagtttgaggaaattcaaaaaagatttggtgaagagttctttaatatatgctttcatgagaatgagagagtccttcgagctgtaggtggcactttgcaggacttttttaacggctttgatgctttgttggaacacattagaacttcttttggaaaacaggccactctggagtcaccatctttcctatgcaaagagctccctgaaggtactctcatgctccactacttccaccctcaccatattgtggggtttgcaatgctggggatgattaaggctgcaggaaagaagatctatcggctggatgtggaagtggaacaggttgcaaatgagaagctatgctctgatgtttcaaacccaggcaattgtagctgtcttactttccttatcaaagaatgtgaaaatactaatatcatgaagaaccttccacagggaacctcccaagttcctgcggacctcagaattagcatcaacaccttctgtagagccttccctttccacttgatgtttgatcccagcatgtcagtccttcagttgggggaaggtctaaggaagcagcttcgatgtgacactcacaaagtgctcaagtttgaggactgcttcgagattgtatctccaaaggttaatgccacctttgaaagggtcctgctgcgactgtctaccccgtttgtgattagaaccaagcctgaggcttctggctctgaaaataaagacaaggtgatggaagtcaaaggacaaatgatccatgttccagaatcaaattccattttatttttgggctctccatgtgtggacaagttggatgaactcatgggccgagggctacatctctcagacatccctatccatgatgccacccgagatgtcattttggttggtgagcaggcaaaggcccaagatgggttgaagaaaaggatggataaattaaaggcaactttagaaagaactcaccaggccctggaagaagagaaaaagaagacagtggatcttctatattctattttccctggtgatgtagcccagcaattatggcaagggcagcaagtacaggccagaaagtttgatgatgtcaccatgctcttttcagacattgttggcttcacagccatatgtgcccagtgtactcccatgcaagtaatcagcatgctgaatgaactgtacaccagatttgaccaccagtgtggatttttggatatttataaggtggaaacaataggtgatgcctactgtgttgcagcagggctccacagaaaaagcctctgccatgctaaacccattgctctgatggccttgaagatgatggaactttcagaagaggtgctgacacctgatggaagaccgattcagatgaggataggaattcactcaggctccgtgctggctggagttgttggggtgcgaatgccacgttattgcctgtttggaaataatgtcacactggcaagcaaattcgagtcgggaagtcaccctcggcgcatcaatgtcagcccaaccacttaccaattattaaaacgagaagaaagtttcacattcattccgcggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgagaacaagcagcaaaatttctgtattatgtcaggcaataatcctactaaaaggtggaggtgaccgctgtcaataaaaagccggaggatgagggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagccagttttgattatatattcctacatttagtgagttggtgggtgaggaatattttctaagtttctttttctgaacagacatttcatacatgtatcatggcagtgtggtaaacttcccaactggaagaattgtaactcggcaaaatattttagggatattacctatttttatacatatctcttctagataactacatttcgcacaacattattagattttcagaatctgcttctgtattgttagtatattatatataatgctaacctattaatctaatatagtttcccttatttagagagatcagtgcttcgactgagaatacatataaccaaggatttcagataccaagaaagcattatatgtctgcttagtaaatatatcttttagatttaactaatgtagcatggaatccagaggaaatggaatttcctaacaccagatgtatctgtaaccaagattaaagaaaggtctttttgccaccttctaacaaatatcagttaaaatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatattactggctcacactaaaattaggagcatcaggtgtccagagttttcctgtttgggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaacaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggagagaagtattgtatttatatatctcaatttatcagaagaatcacaaattctgtattagtttatatgattttacttagagaataagtatccatttacattgccataaatgtcacgatgaagaacgtgccagagatttcttatttatcactgacaggatgtcaactacatttttcatacattataacctaagtgtattttcacagctatagtccgagataatggtccaatttgttatcattttgctaatctattatagttgattattgtagttacaatgttgctatatatgtttatgaggtactatataaaatgtctgttcattcaaacttcaatcacagaagttagaagatggagaaaaaattatatttttatttgtcctacacaatgccatctacatctcttctcttaggaattgtgattgtaacaatgtggtggcatttgttatttcatatgacttttatctatacagtattctcacttacttacaaactattaccaacagcatgcattttagtatggcagatacaagaaatttgtgtgatgttcccttagaaaccaaatgatattaaattggggaaatggttttaacccactctgcaagggatactttaaaatataatttggcacctatagctcttgcattttaatattcttttaagctgctgtttggaagaaggcaccttataactagccattagcaccaaagcatcacgttggtatcaggattattttgatggagagaatgtcatcatttgcaaataaatcagttatctaacaaaatcagaatcccccaatatgtactcagaatgtactaccctgtatcttctttgtggaccttaatcattaggtaacattggccataataaaaaataataatatgcttcagaaa

SEQ ID NO: 13133 - DNA, 4400 bp, Homo sapiens
aggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttagttaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacata

SEQ ID NO: 13134 - DNA, 2631 bp, Homo sapiens
atggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacagtgcggatttgcgaggcgcgccctggagctgctagagatccggaagcacagccccgaggtgtgcgaagccaccaatctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttc

SEQ ID NO: 13135 - DNA, 2715 bp, Homo sapiens
acacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaa

SEQ ID NO: 13136 - DNA, 2992 bp, Homo sapiens
ttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaa

SEQ ID NO: 13137 - DNA, 2656 bp, Homo sapiens
gacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtggacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaaaaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaa

SEQ ID NO: 13138 - DNA, 3124 bp, Homo sapiens
gtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtg

SEQ ID NO: 13139 - DNA, 2316 bp, Homo sapiens
aatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatgaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgttta

SEQ ID NO: 13140 - DNA, 2456 bp, Homo sapiens
agctcgatgctgcctccccggcccggttgcgctgtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaagagagaagaggtcttggtatgtcgcccaggctgttctcaaattcctgagctcaacggatcctcccacctgggcttcccaaagtgctgggataacaggcatgagccaacctgcccagccagaaaagagagattttaatgcttatgtgctttataaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaattta

SEQ ID NO: 13141 - DNA, 2355 bp, Homo sapiens
gctgagcgccagcggaagggaaggctccgggttcgcgtccccgcgctgcccccgatgcccagcctctcccggagcggtgacagtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatat

SEQ ID NO: 13142 - DNA, 3834 bp, Homo sapiens
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcatcctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaagg

SEQ ID NO: 13143 - DNA, 3623 bp, Homo sapiens
caaaagggggaccggccctgtgacccctcaccgggggccgtgggcccgagcccccggacttccctaagccggcaatgaccgcctgcgcccgccgagcgggtgggcttccggaccccgggctctgcggtcccgcgtggtgggctccgtccctgccccgcctcccccgggccctgccccggctcccgctcctgctgctcctgcttctgctgcagccccccgccctctccgccgtgttcacggtgggggtcctgggcccctgggcttgcgaccccatcttctctcgggctcgcccggacctggccgcccgcctggccgccgcccgcctgaaccgcgaccccggcctggcaggcggtccccgcttcgaggtagcgctgctgcccgagccttgccggacgccgggctcgctgggggccgtgtcctccgcgctggcccgcgtgtcgggcctcgtgggtccggtgaaccctgcggcctgccggccagccgagctgctcgccgaagaagccgggatcgcgctggtgccctggggctgcccctggacgcaggcggagggcaccacggcccctgccgtgacccccgccgcggatgccctctacgccctgcttcgcgcattcggctgggcgcgcgtggccctggtcaccgccccccaggacctgtgggtggaggcgggacgctcactgtccacggcactcagggcccggggcctgcctgtcgcctccgtgacttccatggagcccttggacctgtctggagcccgggaggccctgaggaaggttcgggacgggcccagggtcacagcagtgatcatggtgatgcactcggtgctgctgggtggcgaggagcagcgctacctcctggaggccgcagaggagctgggcctgaccgatggctccctggtcttcctgcccttcgacacgatccactacgccttgtccccaggcccggaggccttggccgcactcgccaacagctcccagcttcgcagggcccacgatgccgtgctcaccctcacgcgccactgtccctctgaaggcagcgtgctggacagcctgcgcagggctcaagagcgccgcgagctgccctctgacctcaatctgcagcaggtctccccactctttggcaccatctatgacgcggtcttcttgctggcaaggggcgtggcagaagcgcgggctgccgcaggtggcagatgggtgtccggagcagctgtggcccgccacatccgggatgcgcaggtccctggcttctgcggggacctaggaggagacgaggagcccccattcgtgctgctagacacggacgcggcgggagaccggctttttgccacatacatgctggatcctgcccggggctccttcctctccgccggtacccggatgcacttcccgcgtgggggatcagcacccggacctgacccctcgtgctggttcgatccaaacaacatctgcggtggaggactggagccgggcctcgtctttcttggcttcctcctggtggttgggatggggctggctggggccttcctggcccattatgtgaggcaccggctacttcacatgcaaatggtctccggccccaacaagatcatcctgaccgtggacgacatcacctttctccacccacatgggggcacctctcgaaaggtggcccaggggagtcgatcaagtctgggtgcccgcagcatgtcagacattcgcagcggccccagccaacacttggacagccccaacattggtgtctatgagggagacagggtttggctgaagaaattcccaggggatcagcacatagctatccgcccagcaaccaagacggccttctccaagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggaggaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgaggaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctgttcaagaacatcaacaagggccggaagacgaacatcattgactcgatgcttcggatgctggagcagtactctagtaacctggaggatctgatccgggagcgcacggaggagctggagctggaaaagcagaagacagaccggctgcttacacagatgctgcctccgtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtccatgcgtggcaggcgtggtgggcctcaccatgccgcggtactgcctgtttggggacacggtcaacaccgcctcgcgcatggagtccaccgggctgccttaccgcatccacgtgaacttgagcactgtggggattctccgtgctctggactcgggctaccaggtggagctgcgaggccgcacggagctgaagggcaagggcgccgaggacactttctggctagtgggcagacgcggcttcaacaagcccatccccaaaccgcctgacctgcaaccggggtccagcaaccacggcatcagcctgcaggagatcccacccgagcggcgacggaagctggagaaggcgcggccgggccagttctcttgagaagtgaggcccggccccggacagggtctgggccctgctccctgtcccatctgcagtggaccccaggcacccccctttgaggaggtggggtgaactgctccttggcagggatttgtgacactgcattgctgggctgtgttcctcgggctcttctggaccttgcaccgtggataccaggccatgtgccatggtatttgggtcctgggagggtgggtgaaataaaggcatgctgtcttc

SEQ ID NO: 13144 - DNA, 3714 bp, Homo sapiens
tctgcggatgctgaagagtgattttcaaaacatttactaacgctttcaattatttaccccattaatggaatttgtcaacagactggagtccttgacaggattgtgaatgcatagaggatgcaaagaaatggacacactgaggtagctatgccagtggtctgcatgcgcaggcagtaaactgaagacatttgagcggtgaattacttggcatttggaaacaccaccgtctgtgtcgggaaagcagaataactctccagtatctcgtcattagcttgctggaagcaggagggctatgttcctgggactcgggcgcttttctcgccttgttctctggtttgcggctttcaggaaactgctgggacaccatggccttgcatctgccaagttcctgtggtgcttgtgccttctgtctgtcatgtcccttccgcagcaggtgtggacactcccctacaagataggggtggtgggcccttgggcttgtgattcgctgttttcaaaggccctgcctgaggttgctgcgcgattagccattgagcgaatcaaccgggacccatcttttgacctgagttattcttttgaatacgtgattctcaatgaagactgccagacttcgagggctctctccagtttcatttcccaccaccagatggcctcaggatttattggacctaccaaccctggctactgcgaggcagcctcgctcctgggaaacagctgggacaaaggaattttctcttgggcttgtgtgaattatgaattagacaataaaattagctacccgaccttttctcggacactcccttctcccatccgggtgcttgtaactgtcatgaaatatttccagtgggctcatgctggagtcatttcctcagatgaagacatttgggtgcatacagccaatcgagtcgcaagtgctcttcggagccacggcttacctgtaggggtcgtcctgaccacaggacaagacagccaaagcatgcggaaagccctccagaggattcaccaggcagacagaattcgcataatcatcatgtgtatgcattcagctttgattgggggagagactcagatgcatctcttggaatgtgctcatgatctgaaaatgactgatggaacctacgtctttgttccttatgatgccctgctctacagtttaccttataagcacaccccctaccgggtcctaaggaacaacccaaagctccgggaagcctatgatgcagtgttgaccattacagtggagtcccaagaaaagaccttctatcaagccttcacagaggcagcagcaagaggtgaaattcctgagaagctggagttcgatcaagtttcaccgttgtttggaaccatctacaattcaatttactttatcgcacaagccatgaataatgctatgaaagaaaatggacaggctggtgctgccagcctggttcagcattccagaaacatgcagttccatggattcaaccagttgatgaggacagattcaaatggaaatggaatttcagaatatgtaatcctggacaccaacttgaaagaatgggaactccatagcacctacactgtggacatggaaatggagctgctacgtttcggagggacccctattcacttccctggtggcaggccccctagagcagatgcaaaatgctggtttgcagaagggaagatctgccatggaggcatcgaccctgcctttgccatgatggtctgccttactttgcttatagccctgctgtctattaatggatttgcttactttataaggcgtcgtataaataaaatccagttgatcaaaggacccaatagaattctactgactttggaggatgtaacgtttatcaatccccactttggcagtaagagaggaagtcgtgccagtgtaagcttccagattacctcagaggtccaaagtgggaggtccccaagactctccttttcttcagggagtctaactccagctacctatgaaaactccaacatagcgatttatgagggtgattgggtgtggctgaaaaagttctcccttggagattttggagaccttaagtccatcaaatcaagagcaagtgatgtgttcgaaatgatgaaggacttgcgtcatgagaatattaaccctttattgggtttcttctatgattcggggatgtttgccattgtgacagaattctgttcccgagggagcctagaagacatactgacaaatcaagatgtgaaacttgactggatgtttaaatcatcactcttgctggatctcataaagggcatgaagtacttacaccacagagagtttgttcatgggaggctaaagtctcgaaactgtgtggtagatgggcgttttgtactaaaagtgacagattatggctttaacgacatcttagaaatgctgagactctctgaagaggaatcttctatggaagagctgctgtggacggcccctgaactgttgagagctccaagaggcagcaggttaggttcttttgcaggagatgtctatagctttgccatcatcatgcaagaagtgatggtccggggtaccccattctgcatgatggatctgccagctcaagaaatcataaacagacttaagaagcctcctcctgtgtacagaccagtagttcctcctgagcatgcccctccagaatgtctccagctgatgaagcagtgctgggctgaggctgcagaacaacgaccaacttttgatgaaatatttaaccagtttaaaacttttaataaagggaagaagaccaatattattgattctatgcttcggatgttggagcaatattctagcaacttggaagatttgattcgggagcggactgaagagctggaaattgaaaaacagaaaacggaaaagcttctaacacagatgctaccaccatcagttgctgaatctctcaaaaagggctgcacagttgaacctgagggctttgacttggtcaccttgtacttcagcgacattgtgggcttcacaaccatttcagccatgagtgagcccattgaggtcgtggatcttctgaatgacctgtacacactctttgatgcaataattggcagtcatgatgtctacaaggtagagaccattggagatgcctacatggtggcttcaggcctcccaaagaggaatggcagtaggcatgcagctgagattgcaaacatgtccttagatatcctgagctctgtgggcactttcaagatgcggcacatgccagaagtgccggtccgaattcgaattggccttcactcagggccggttgttgctggagtggtgggcctcaccatgcccagatactgcttgtttggagacactgtgaacacagcttctcggatggaatctacaggcttaccttatcgcattcatgtcagtctcagcactgttacaattcttcaaaatctgagtgagggctatgaagtggagcttcgaggaagaacagagctcaagggcaaaggcacagaggaaaccttctggctgattgggaaaaaaggcttcatgaagccccttcctgtgcccccaccagtggacaaagatgggcaagtgggccatggcctgcaaccagtggagattgcagccttccaaagaagaaaagcagaaaggcagttggtgagaaacaagccataaggggcaaagggctccaggatttgaatcttctcttggtgaggcaatgggaaagctcacttcagttcaagaaattgttctgcctgggcaagaaatta

SEQ ID NO: 13145 - DNA, 1874 bp, Homo sapiens
cagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaagagaa

SEQ ID NO: 13146 - DNA, 1575 bp, Homo sapiens
tgcttctctaagccttgttctattttcaactcttttctccagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgct

SEQ ID NO: 13147 - DNA, 1924 bp, Homo sapiens
agtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccagtttcctcatcaataccaaaagacggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaag

SEQ ID NO: 13148 - DNA, 2233 bp, Homo sapiens
acctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcaggttcaatttctacacctcccagtactccaactccctgaaccccttctacactttgcagaagcctacctgtggctacctgtaccgccgggacactgaccacacccgcaagcgctttgatgtgcctcctgccaacttggtcttgtggcgctcctaggcctgagccaaacggaagcccccgacccttcaccctcacccctgtgacctcaggtccccaaggggaagggctgctcactgcaggaggagtgacctatattcgggctaagacagctgtgccatgcccacctattgacaatgataaagggaggtctctcttctcagcagcagttaaagtttgtccttcctttccctggcatctgaatgggtggctgtggggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctgagtgcaccgcccggctgcttctgcactagcgggtggggtggtatggtggtgcctgttggtggtgttcttgtcttaaccctagatagaatctaatgaactcagaggcttagctcgcctctttagggtccatggtggcagcagagaggcagaagtgggagtccagagccaggaacagtgaaggatggttcctggcccctctgagtgacagctggtggcagcactccttgctggggggcactgttcaacatccctctgccgtcgggtgaccccctagcccttctgactcctctcccagcttttcccagctttccccactgagcttctccagtccatgctcttctggacgtggactctctgaggcagaactgagcttttccaggcctcttatggaatcctgcagatccagtggctgcagcttcaatcccagtgctgcaatcacacatccattctgccctgggggaccctggagcctacttgtgcgctttgcatttcattgattgacgcctcccttcaacaagcatttactgagcgcctactatgtactaatgctagatgttagatgtacaaagaagacagttttcatcctctaggaactcataggctaatggtgagacacacagacaaacatcattataataaaatatgctaagag

SEQ ID NO: 13149 - DNA, 801 bp, Homo sapiens
agtatcctgccaagagtcctccctgaccaccagaagttccacctcaccatcaagaaaggccctggtccaggatgtgcaaggactcacagaaaccctctgtacccagtcatgggccaaagacaccgtcatgcaagggggtgaaggctccacactcgtcccggccccgggcgtggaagcaggacctcgagcagtctctggcagcagcctatgtgccggtcgttgtggactctaaggggcagaatccggacaagctcagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtg

SEQ ID NO: 13150 - DNA, 1075 bp, Homo sapiens
agtatcctgccaagagtcctccctgaccaccagaagttccacctcaccatcaagaaaggccctggtccaggatgtgcaaggtgtgatgaaatcacagggctggggaaggtcagctcggggtcacaagaagcctgatgggcaggaaagagcatgaaagccccagccagcctcacatgtgcggctgggagggtacagtctcccctggggctgcaaggatttagtggagactcttaacaccagttctctggcatctgtgagtttgagtgtgggccatcatcttcttccttctgctctctccctctccacatttcccggtaccatctgatccatcaggcccttctttgctcaggcctgaaggactcaggcctgtgagagaggacggccccgttgtcggccaagacacctttgggcgaggagcagcgaacagggcctgtccatctcagacgtcagccccctgaaggcctgagcaatgggcaacgtgatggagggaaagtcagtggaggagctgagcagcaccgagtgccaccagtggtacaagaagttcatgactgagtgcccctctggccaactcaccctctatgagttccgccagttcttcggcctcaagaacctgagcccgtcggccagccagtacgtggaacagatgtttgagacttttgacttcaacaaggacggctacattgatttcatggagtacgtggcagcgctcagcttggtcctcaaggggaaggtggaacagaagctccgctggtacttcaagctctatgatgtagatggcaacggctgcattgaccgcgatgagctgctcaccatcatccaggccattcgcgccattaacccctgcagcgataccaccatgactgcagaggagttcaccgatacagtgttctccaagattgacgtcaacggggatggggaactctccctggaagagtttatagagggcgtccagaaggaccagatgctcctggacacactgacacgaagcctggaccttacccgcatcgtgcgcaggctccagaatggcgagcaagacgaggagggggctgacgaggccgctgaggcagccggctga

SEQ ID NO: 13151 - DNA, 1113 bp, Homo sapiens
ggaaagggaggaagagggccctagttggagagatccatcagcagaagccagggaggagatacagacccttgctccctgatgctcctcagggctagcatggggcaggagtttagctgggaggaggcggaggcagctggcgagatagatgtggcggagctccaggagtggtacaagaagtttgtgatggagtgccccagcggcacactctttatgcatgagtttaagcgcttcttcaaggtcacagacgatgaggaggcctcccagtatgtagagggcatgttccgagccttcgacaagaatggggacaacaccatcgacttcctggagtacgtggcagctctgaatctcgtgctgaggggcaccctggagcacaagctgaagtggacattcaagatctatgataaggatggcaatggctgcatcgaccgcctggagctactcaacattgtggagggaatttaccagctgaagaaagcctgccggcgagagctacaaactgagcaaggccagctgctcacacccgaggaggtcgtggacaggatcttcctcctggtggatgagaatggagatggccagctgtctctgaacgagtttgttgaaggtgcccgtcgggacaagtgggtgatgaagatgctgcagatggacatgaatcccagcagctggctcgctcagcagagacggaaaagtgccatgttctgaggagtctggggcccctccacgactccaggctcacccaggtttccagggtagtaggagggtccctggctcagcctgctcatgcccactcttcccctggtgttgacttcctggcaccccctgtgcagggctgagtggggatggggaagggctgctgggtttgaagtggccaacagggcatagtccattttggaggagtccctgggatggtgaagggaattcagttacttttcctgttcagccgctcctgggaggactgtgccttggctgggtggttgtggggctcccacagtttctgggtgttctcagttggaagcaagagccaactgaggggtgagggtcccacagaccaaatcagaaatgagaacacaaagactggtaggaggcaggggtgggagggtgttgagactgaagaaa

SEQ ID NO: 13152 - DNA, 652 bp, Homo sapiens
agtcacccaggagatgatggagaggctgatcaggcctcctggaaagggaggaagagggccctagttggagagatccatcagcagaagccagggaggagatacagacccttgctccctgatgctcctcagggctagcatggggcaggagtttagctgggaggaggcggaggcagctggcgagatagatgtggcggagctccaggagtggtacaagaagtttgtgatggagtgccccagcggcacactctttatgcatgagtttaagcgcttcttcaaggtcacagacgatgaggaggcctcccagtatgtagagggcatgttccgagccttcgacaagaatggggacaacaccatcgacttcctggagtacgtggcagctctgaatctcgtgctgaggggcaccctggagcacaagctgaagtggacattcaagatctatgataaggatggcaatggctgcatcgaccgcctggagctactcaacattgtggagtgccggcgagagctacaaactgagcaaggccagctgctcacacccgaggaggtcgtggacaggatcttcctcctggtggatgagaatggagatggccagctgtctctgaacgagtttgttgaaggtgcccgtcgggacaacctgctcatgcccactctt

SEQ ID NO: 13153 - DNA, 982 bp, Homo sapiens
ttgctgtaagaggtttagagtagctttctgagggcatatgttagccttcagttttagtgaggagtaagggactaaatccagcaaaaacttaagtgaaaacaacctgaggaaaagctgtagactgtgagtcaagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatg

SEQ ID NO: 13154 - DNA, 900 bp, Homo sapiens
atggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggatggatttgttgactttttggagtttattgctgctgtaaatctaatcatgcaagaaaaaatggagcaaaaattaaaatggtattttaagctgtatgatgctgatggaaatggttctattgacaaaaatgaactactggacatgttcatggcggtacaagccctcaatggccagcaaactctgagtcctgaagaattcatcaacttggtgttccataagatcgatataaacaatgatggtaatggagctactctctactggatcacttttcctacaaagggaattgactttagaagaatttatcaatggcatggcaaaagatcaggatctcctggagattgtttacaagagcttcgacttctccaatgtgctgagagtaatctgtaatgggaagcagccagacatggagacagactcctccaaatctcctgacaaggctggtctagggaaggtgaaaatgaagtagctgtgagaatacctgtcccagctatcaatgagcacaacatttcagtagagaagaaatagaatcttccccatgtacatgctgttgatttcaggtctttgttataattcatataggcttgtgaatatagcacttattttaatccagtagagacttgcataaagatcctaaacagatgcattgttgcttttctgtgctgtctctgcagattaaaacataatgattacactaaa

SEQ ID NO: 13155 - DNA, 569 bp, Homo sapiens
gctgccatgaatgccttcctgctctccgcactgtgcctccttggggcctgggccgccttggcaggaggggtcaccgtgcaggatggaaatttctccttttctctggagtcagtgaagaagctcaaagacctccaggagccccaggagcccagggttgggaaactcaggaactttgcacccatccctggtgaacctgtggttcccatcctctgtagcaacccgaactttccagaagaactcaagcctctctgcaaggagcccaatgcccaggagatacttcagaggctggaggaaatcgctgaggacccgggcacatgtgaaatctgtgcctacgctgcctgtaccggatgctaggggggcttgcccactgcctgcctcccctccgcagcagggaagctcttttctcctgcagaaagggccacccatgatactccactcccagcagctcaacctaccctggtccagtcgggaggagcagcccggggaggaactgggtgactggaggcctcgccccaacactgtccttccctgccacttcaacccccagctaataaaccagattccagagt

SEQ ID NO: 13156 - DNA, 597 bp, Homo sapiens
gacagcggcagggggaacccagggagcgcgatgggctgcagggctgcatcagggctcctgccaggagtggccgtggtcctcctgctgctgctgcagagcacacagtcagtctacatccagtaccaaggcttccgggtccagctggaatccatgaagaagctgagtgacctggaggcacagtgggcacccagcccccgcctgcaggcccagagcctcctgcccgccgtgtgccaccaccctgctctgcctcaggaccttcagcctgtctgcgcctcgcaggaggcttccagcatcttcaagaccctgaggaccatcgctaacgacgactgtgagctgtgtgtgaacgttgcgtgtaccggctgcctctgagatagccctgggtaccctgagcccaccagggacacctcgcccttcagcccaccaccctggcaggcttccatccccgtccatgctcaagatgggtccctggccaccatggtcatcaccacccttccagggcctgagcagctggatctggtacaaagcaatcggacatagagttggagggggaggcccctgaggcagcccagctcctgaataaagattctacaacacacg

SEQ ID NO: 13157 - DNA, 1084 bp, Homo sapiens
gaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaa

SEQ ID NO: 13158 - DNA, 940 bp, Homo sapiens
cagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaatgagtggaatgtggccccaaggttggtgg

SEQ ID NO: 13159 - DNA, 1275 bp, Homo sapiens
cgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactcca

SEQ ID NO: 13160 - DNA, 689 bp, Homo sapiens
tgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggagggataccacgaggaacccgaggcccggcgaggagaacggcaaagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcat

SEQ ID NO: 13161 - DNA, 850 bp, Homo sapiens
gctggccgggctggctgcggccgccctgggccgggccccaccggacgcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctgcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtgg

SEQ ID NO: 13162 - DNA, 844 bp, Homo sapiens
gatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcccggctgggctggaaagctgtcccacagccgcagtgaggacagccgcaggccagagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtgg

SEQ ID NO: 13163 - DNA, 873 bp, Homo sapiens
agaggtggccccggatgctgcggcgcccgctggccgggctggctgcggccgccctgggccgggccccaccggacgcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcc

SEQ ID NO: 13164 - DNA, 842 bp, Homo sapiens
gaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaa

SEQ ID NO: 13165 - DNA, 937 bp, Homo sapiens
cttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaac

SEQ ID NO: 13166 - DNA, 990 bp, Homo sapiens
agtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccataaa

SEQ ID NO: 13167 - DNA, 1012 bp, Homo sapiens
tgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgagg

SEQ ID NO: 13168 - DNA, 760 bp, Homo sapiens
atgtcgggccccaggcctgtggtgctgagcgggccttcgggagctgggaagagcaccctgctgaagaggctgctccaggagcacagcggcatctttggcttcagcgtgtcccgtgagtccaataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcgaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggatt

SEQ ID NO: 13169 - DNA, 865 bp, Homo sapiens
ctggccgggctggctgcggccgccctgggccgggccccaccggacggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcagcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtgga

SEQ ID NO: 13170 - DNA, 656 bp, Homo sapiens
cccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggc

SEQ ID NO: 13171 - DNA, 3342 bp, Homo sapiens
aaaggaaggggcggcgtccacatggttacccttctgctgcgcgggtcaagtagcttcttctggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttatttctccagtgcgtttttatgaagatctggttgaaaattgtatttctatgtaaactcaacgatatgtttggttttcctgaaaataaatgattttaaataaa

SEQ ID NO: 13172 - DNA, 3544 bp, Homo sapiens
tggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaaggtagagtaaggaagacttagctggtgttgggcttggcgggtccacttggtacgctgggcaaactccaacagcaagaattgaagacttaagggtttgagcagatggttttctacctaaattgaataattcaattacgtattctcagctagcatggatttgggtcatggaattaaagtagaaacgtatccggcatgacttctttgtgcttatcaaaagtgatcctgataaacagatcttgctctttcatgtaaagaagtaaaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttatttctccagtgcgtttttatgaagatctggttgaaaattgtatttctatgtaaactcaacgatatgtttggttttcctgaaaataaatgattttaaataaa

SEQ ID NO: 13173 - DNA, 1932 bp, Homo sapiens
agactgagctcagtagccaggcatgaaagagactgggcaagttgcaggggctaattggaaaggggctgtcggttgcacttggggtttaaacaagaggtttcttttgcaatgagaatttttaggtggctaagatcagtcttcttggcaaaaaaataaactaagcatagagtgcagttggatatgaccgaggaaattacaaaaagggctccaggagcaaagtctgaactttccttatcagtgttgcagtggaatagctgggggcctgatgctgtttgtgctgatcatactttgcaaatgcccacactttgttgctgtttgtctccttggacgaggtttgctgcaacttcaattccttgacttcggccttactttgttttcatagcagcaagaattgaagacttaagggtttgagcagatggttttctacctaaattgaataattcaattacgtattctcagctagcatggatttgggtcatggaattaaagtagaaacgtatccggcatgacttctttgtgcttatcaaaagtgatcctgataaacagatcttgctctttcatgtaaagaagtaaaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaat

SEQ ID NO: 13174 - DNA, 1242 bp, Homo sapiens
cgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggatt

SEQ ID NO: 13175 - DNA, 1376 bp, Homo sapiens
cccggccgggagcgacccggagtccccagccccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctga

SEQ ID NO: 13176 - DNA, 583 bp, Homo sapiens
gagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgaggtacggagatttatctaggctcttccctggctgcgaacccaggctccctccagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaa

SEQ ID NO: 13177 - DNA, 1595 bp, Homo sapiens
gcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgtaagtatcccagatgttgtagggtggtttgttctgttttataagccaggaattgtcttgcttctggcattggcaaagtatttgaaaatgaataattttctgtaaattattctgtaaaaagtctgtaaatacttagctgtactaatagatttattttgtcatgagaatatgcttcaggatttcatctgtaactaaattctcatggtcatgagcataaacttacatgtaaatttcttttattagaatgccatgcctgcttatgttatgcatgtattttataataatttaatctattttacaattttaaactcaaatatgatttagtattatgcacataatacaaacagtagtggtgagcaaacgtgtgtttcccccacatgtgcagaatatgatggattttatgaaaataaatattcttaactccaggaaatatgatctatatggttccttaaaagattttccaatacactgaaaatttagttccttatgttcattgtataaaaatcttaggccaggcgcggtggctcacgcctgtaatcccagcacttcgggaggccgaggcgggcagatcatgaggtgaagagatcgagaccatcctgaccaaaatggtgaaactctgtctctactaaaaatacaaaaattagctgggtgtggtggtgtgtgccagtggtcccagctactagggaggctgaggcaggaaatcacttgaacctgggaggcagaggttgcagtgagccaagatcgcgccactgaattccagcctggcggcagagtgagactccatctcaagagaaaaaaaaaaaa

SEQ ID NO: 13178 - DNA, 2329 bp, Homo sapiens
ggaagaaacacagatggcggcggcgcagcgccattccgggccgggagcaggcagccagcagccctgtcctcaccgcggtccgcccgccgccgctaaatacccggatgcgccgcccaagcgccagacgcggagctgggaaaagggaggcagaggaggcggaggcagaggcagaggcagaggcagagcccgagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtggggagaagacacaaggcagtttgttctggctagatgagagggaacccaggaattgtgaggttagcaggaatatctttagggtgagtgagttttctttgagttgggcacccgttgtgagagtttcagaacctttggccagcaggagagaggtggtagggagcagccagccggcaaaggaaggagggggaaaaaaaccgccaccgggctgacttccacctcccagtggtgagcagtgggggcccaaacccagtttccttctcatttttgttagtttgcgctttcggcctccctattttcttagggaaggggagtggggtccaagtgacagctggatgggagaagccatagtttctcccagtcagctaggatgtagccattgggggatctttgtggcttcagcaaattctcttgttaaaccggagtgaaaacttcaggggaagggtggggagtcagccaagtgcctcagtgtgccctgttgaaacttaggtttttccacgcaatcgatggattgtgtcctaggaagacttttcttttcctctggatttttgttcctcctgtacaagaggtgtctttgcttggtttggtggggctgcggccacttaaaacctcccgatctctttttgagtcctttattataagtagttgtagctgcgggagggggagggggagtgggcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgcgtcccccccccacccccttttttaaacaagtgttacttgtgccgggaaaattttgctgtctttgtaattttaaaactttaaaataaattggaaaagggagaaactg

SEQ ID NO: 13179 - DNA, 1172 bp, Homo sapiens
agacgcggagctgggaaaagggaggcagaggaggcggaggcagaggcagaggcagaggcagagcccgagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaataattttctccttttttctctcttgatgctcaccaccaccttttgcccccttctgttctgactttataagagacaggatttggattcttcagaaattacagaataattcatttttccttaaccagttgtgcaaggacagcaacaaccaatctaatgatgagaatgtacttatattttgttttgctattaacctacttacggggttagggatttgcggggggggcttgtgtgttttgttggcttgtttgccatgaaggtagatgtgggtgg

SEQ ID NO: 13180 - DNA, 1308 bp, Homo sapiens
ttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttggtagttgcatatggtgatttttgatttttcaatgctggtaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactat

SEQ ID NO: 13181 - DNA, 1863 bp, Homo sapiens
atctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggtaaaatggtgggtgggaagactcagagtttgtattcctgttgtgtaccaagaacagttccaaattgttgcatgtgcttatatcatttaatcacaagcctgtcaggtagttgatattgttacttcactgttgagacttcagaaaggttaaattgctcaaggtcatacacgtagaaaatggcaaaaccataatttgaacctatttgactccaaggcttagtgcacattccattataccatttaaaattttgaaacattgcactaaaaacaatatttaaagaaaatcctctggtttggtttatggatgctgcaggacattaagaagaacttgagactagaggtctatatttgtagtaacaatttcaaacaacagtgcctagaataaaagaaatgtctcttcaggtcctgaagaaacatataggtagagagagcttaatacctaggatgggaataggcagtattaaaaaattatgcattaagacgtaaaaggagcagtgagtggaggataggattggattggcaagattgggggaacggtgcttaaaggtgatactggacgtgtaaaggggccaggatttgccttgtggtttcctaaaggggattagggattgccacttacatgtggagcatattgaatttaatcttaatctctagcatgtcaggacttagagaaatactgttctagagatatttatgtatttgagatatttgtggtttaagttaagaccaaaacttgaaattcctacaagatacttgataaaggtatgtagacgtcattaacatcagtcacttaagtaacctattttatattgtgtggttggattctttagttgcaagtatcccagaatacagtaaagctaccacctccatcagaagcatgcagttgggggtcgttaaaaatgctgattgttaggcaccattgcagacctgaatcattctgggggtggggagggggcatccagaatctaagtacattccattggaggattttcaaggctgctgttgctgtgctgggcttttgctttatgtatgagaaagataggataggtggattccaccctgaagtgtaattggtcgagctgtttctatggttaatctaaacttcatttgattggtgaattccaggagtaggcatccattaaattctcagtgagttgctgaaatttcaactactaaaatcttccatgtttttacttaaaactttattttctgttttaatagccgattatcttcagttcttatttattactaaatacagaaatgttactaagattcgtaagcattggtacaaagctgctaatattttctagttagaactgtgcttaaagaacaatactgtacttgaaaagtgtagcgtttttagcttaaatgtcaataatgtagccttttaaattgaatttactaaacaatctgggtaaaagactcatctttctaaaattattcacatgtaaacttccattg

SEQ ID NO: 13182 - DNA, 1088 bp, Homo sapiens
ggcggcgtgtgttgggggatagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaact

SEQ ID NO: 13183 - DNA, 799 bp, Homo sapiens
cgcgacacagccatcttgcgtcgggggcccgggcccgggaggagagcgagccccgtcccctgatcccggaggccaacaccggcgaggggctgccctgcacgcaggcggccggcccaggagtcttagcggatcaagttgtctacggcggactcgggccggtcccgcaggacccggccgcacttggccgagcgcgcaggcgggaaggaggccgtcggtccgcccctcccgctgccgcagcggccagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaa

SEQ ID NO: 13184 - DNA, 2703 bp, Homo sapiens
gagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttataccccattaaaattgctttctcaaaagtttgggttagtttcaaatgtgatattttggagggaaggtaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagtt

SEQ ID NO: 13185 - DNA, 1893 bp, Homo sapiens
ccgatcagctgtcggcgcgcactcgctcccggcccggcccagcccagcccggcgcggaggccgccgcctgccctgcggggcccgacgccagcggtccgggtagcagctccagggccggcccgcgcgtgcgcccgggagccgcgcgccaccatccccagcggggaccgaggagcccggccgagcccgagaagcccgcggccgcgatgcctgacgagctgacggagcccgggcgcgccacgccggcccgcgcctcctccttcctcatcgagaacctgctggcggccgaggccaagggcgcagggcgcgcgacccagggcgacggcagccgggaggacgaggaggaggacgacgacgaccccgaagacgaggacgccgagcaggcgcggcggcgacggctacagcggcggcgacagttgctcgcgggcaccgggcccggcggggaggcgcgggcccgtgcgctgctcgggccgggcgcgctgggcctcggtcctcggccgccccccggtcccgggccgcccttcgctctgggctgcggaggcgcagcgcgctggtacccacgggcgcacggtggctatggaggcggcctcagtcctgacaccagcgaccgggactcaccggagacgggcgaggagatgggccgtgcggagggcgcctggccgcgaggccccgggccgggagcggtgcagcgggaggcagcggagctggcggcgcgtggcccggcggccggcacggaggaggcgtcggagctggccgaggtccctgcggcggctggggagacacgcggcggcgttggcgtgggcggcggccgaaagaagaagacgcgcacagtcttctcccgcagccaggtcttccagctggaatccaccttcgacctgaagcgctacctgagcagcgccgagcgcgccggcctggccgcctccctgcagctcaccgagacgcaggttaagatctggttccagaaccgccgcaacaagtggaagcggcagctggcagccgagctggaggcggccagcctgtccccgccgggagcgcagcgcctggtccgcgtgccggtgctctaccacgaaagccccccggccgcagccgccgctgggcccccggccaccctgcccttcccgctggcgcccgccgcgcccgcgccgcccccaccgctgctcggcttctccggggccctcgcctacccgctggccgccttcccggccgccgcctccgtgccctttctgcgggcgcagatgcctggcctggtgtgagccccgcctgccgggccctctccccacgaccctgtggacctgtgtggacgcgcgattcagcggcaggcgcagggctcagggggcgttagggaagggatggtcgctcctgcggcctcctagatacctcgggagcgcaggccgcggccgggcgggcctcagcttctgtggggagcgcctctagaatgtaatgggacgccccacccatttgccaggctggatccccactcgaacagggggccatgcagagactctgggctgcgcagcccccggcgccacggccaccccccggcctcagcgaggagcggtcggccatggccacccggggcagctgccctcaggccaagcccagcgcaacaaaggaaaactacgaaccggctgtccaaggctgagcggtgactgtccccacagactgcccccaacactaaacgtccctttcctgggacccagacagcaggccggcccggagggctgtgctacccctctcgcgggtgctggtggagaaaggaccctggacctgtgggtcccatcgtccgttccaggagcaggcaggctggggctctctgcagacgtcgcagcctccgggttgttgtttttttaaatgaatctacttatttgcgtatggaataaaaagggacattttctg

SEQ ID NO: 13186 - DNA, 1628 bp, Homo sapiens
cgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgcccgcagagccgggcgcgtactgtactgtaagcagggctccggagcaaggcggcgtgtttccagaaatatgaagaaatacaccatgtgtattcattagctcttatttatggtctctgccctactttttgttttgattgtttcgggtatttattggcattccctaagtcagagagcctgcttcctacctagaccgaaccagtacgctttgaaaaccattcggagtgagatgttctcgggtggtggtgggaaagggagttttggccagacaggctgtggttggtagggaaaaaaatcaggaaaacacctacaaaaccaggtacactcctcccccatatatacacctgtatatatgtacatgcatacacgctcggccaagccaggccctcagaggctttggacaattactaaattgcttcttttcgtttccctcatcccgaggatggtagggacgaaaaggggagagttcagatctgtaaatatttttaaaaagaaaaaaaaataaaacattttaaacatc

SEQ ID NO: 13187 - DNA, 3911 bp, Homo sapiens
tatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctctatctattgcccaggctggagtgcagtggcgcgatctcggctcacttcgacctccgcctcccgggttcaagtgattctcctgtctcagcctcccgagtagctgggattgcaggtgtgtgccaccacgtccggctaatttttgtatttttagtagagacgcggtttcaccatgttggccaggctggtcttgagctcctgacctcgtgatccgcccgcctcggcctcccaaagtgctgggattacaggcgtgagccactgcgcccggcctagtttattccttttctatagaactgttttcagaatccagagagggagagaattcatatgatagtacttttatttctggatttctgggtatgtttcttcctcccaacccccaaatcagttatccaccttaattttcaaaatatgagcagcctctcataagaatcccgactcaggccgcttttctcttctggagaggtctgttgcaattagcctcttcatcggtcttactttgtgatggaagaattctctaagtgtctaaagagaaaagacagccaaaaatcagaactctgactatttgaaacagctccatatctggcctggtctaagtggtcttatttattagtagcatttattttgagaatttcatttgtaaattattattaatattactattattactttgttccctgttttgagagagtaatttcagtatttttaatatgatatcttttatcctctcctcttacttttcatgttctgcagtaattattgtacgttgacctgtgcaatattgtacaaaatctcctgagaaagctgtttcctcctccaccgtgggaaacagaccttttcactgtataatcatggtcattcatttagaaagaaaaaagtaggcaggggaaaggggggaagaaagaaacaagcttaggtagtgatgctcaaaggagtaagttaggcatactggagcgctttaagtgaaggacaatcaatttagcagaattttaacttatttgataaatgtacagatttcttgtaaagttcaccctctactccgcagggctcctggctctgtcacccaatctgttttctttctgtcggtacacctgttgttctgtgatagtttgtttcccctcatctccctcacctctgcctgggttgagtccctttttaagaaaaagagaaaaaaaaaacccacaaaatattgttacactaatgttgtcgtgacattgaattaattaaaaagaaaagaaaagctttacgtgttgccagagtgtgtaagtttggacgattttccctagagcaaatgtctccaaaactcttttctgtcttgctcgctgactgcctctgcgctctctaagtacaacctggacgcacaaccctgtattccgggaggcggtggagacagaggcggctttgttcgcgaccagaggcactctctcccctgtactttccgcggcctgaaacgcccagcgagcagggaagaatgctgggcggaaggggagtggacttaggcttatctagtttgcgaaattgagcaaagcgacagcgcgcgaggcgagataccagagacagctggtatttccgaacactggtctgcagcctcccgttctgttcttaaacctgggttccttcgggagccgagagcttttgggcagggcatccctgggcattcgtcagctggttaacttcggtgggctctggttggagggaagaagggagtgagttcagagtttagctgcagccgtaggccgattgccaagtcaggctaggaaaggctgggccacaagaggacaaccccagggacagccagctcttgggacagcggctcccactaccaggagaggggaacttcctcaggtcttgcagagctgagattcccggggcgactcgagcatgggcgcggtcctgatgtgctaagtgtgagggaacagaggctacctagctgctgcagctgcaacagagaagaccttgtctcttccgtgccaggctcttctctttcccctggcgcccaacacctcctgggcggcatctctagatccccgaccctgtcctggcagacgccgagaagcgtagcgctcaccacacccgcgcgctactgggttccaggccgccgcgctcttagtgagcagcctgcggaggcacagcgcgccggaaccgcctggaagggtgggtccgcccgacagaagcaggtgcctgggcgacactcgctggccgggtgtggccgcctgcctttaagctgggggtctgcacgtacaattcctggcggggcacctttgaagctggggagccgaaagggggagatgaggaacccaga

SEQ ID NO: 13188 - DNA, 5351 bp, Homo sapiens
ggtgctggaggaggaaaccggcggagcagcttccccactctcagttgcgcttctggcgatggcgatcagaggtcctgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaa

SEQ ID NO: 13189 - DNA, 6336 bp, Homo sapiens
tctcccgggagccactcccatgggcgcctctccagcccctggcctggaagcaccaggaaccctggggatggggcagaccctcacagcccggggtctggagccggtgtcggagctcatctgggcccatgacctctccagacatttggcaaaatcaaggcccttagaccagggacagacccaagcccaggccctcccagaggtcctaggacgcaaccctttgtgcccttgggctctggaagaggtttgggaagggtttggggtggaagatggcaaagagcagcttggccaggtgaggatgaggcagggcagacacaggccagtggggcgtgccatgtgccacagatggagaggaccaggagccagtggcccggcaggcacagcccggttggcgtgggccagagcgcccatcactgacccgtgagaactcgactgcccctgccagctctggcactgccccctcccagccgccccgccctagcaccctggggggcaccccgcccaaccgtggcctggtccggcccctcccgccctttgctccagttcccgggcttggcacctatagtgggggtgccgcccgcctgccaggctccggggccgggcccacgggagggtggggcggctgggaagctggcacgctgccccgggggagcctctctcggcaggcgcccgggtgccgcgggggggagggggaacaaagggctcattctccccgtgcgcagccggtggcatcgccggggcgttggcggaagcccccggggcccgggagggggcaggcccaggcgcggccgccgaatcacgggctcctgtttcccgcagggtgctggaggaggaaaccggcggagcagcttccccactctcagttgcgcttctggcgatggcgatcagaggtcctgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgcgtcctcgcccgccggccgggaggccccggagctggcccatggggagcaggcgcccggtgccggccacgacgaccgccaccgcccgcgccgcgaccggccggtgaagcccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggacccttttccaggcactgcagaacagggggctgggggttggcaggaggtgcgggacacatcgatagggaacaaggatgtggactcgggacagcatgatgagcagaaaggaccccaagatggccaggccagtctccaggacccgggacttcaggacataccatgcctggctctccctgcaaaactggctcaatgccaaagttgtgcccaggcagctggagagggaggagggcacgcctgccactctcagcaagtgcggagatcgcctctgggaggggagctgcagcaggaggaagacacagccaccaactccagctctgaggaaggcccagggtccggccctgacagccggctcagcacaggcctcgccaagcacctgctcagtggtttgggggaccgactgtgccgcctgctgcggagggagcgggaggccctggcttgggcccagcgggaaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggctttcaggagcagtccgcggaggagtgcacgcaggaggccgggcacgctgcctgttccctgatgctgacccagtttgtctccagccaggctttggcagagctgagcactgcaatgcaccaggtctgggtcaagtttgatatccgggggcactgcccctgccaagctgatgcccgggtatgggcccccggggatgcaggccagcagaaggaatcaacacagaaaacgcccccaactccacaaccttcctgcaatggcgacacccacaggaccaagagcatcaaagaggagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcttcgcccaaagtcagacgagggctctgtcctcctgctgcaccgagctttgggggatgaggacaccagcagggtggagaacctagctgccagtctgccacttccggagtactgcgccctccatggaaaactcaacctggcttcctacctcccaccgggccttgccctgcgtccactggagccccagctctgggcagcctatggtgtgagcccgcaccggggacacctggggaccaagaacctctgtgtggaggtggccgacctggtcagcatcctggtgcatgccgacacaccactgcctgcctggcaccgggcacagaaagacttcctttcaggcctggacggggaggggctctggtctccgggcagccaggtcagcactgtgtggcacgtgttccgggcacaggacgcccagcgcatccgccgctttctccagatggtgtgcccggccggggcaggcgccctggagcctggcgccccaggcagctgctacctggatgcagggctgcggcggcgcctgcgggaggagtggggcgtgagctgctggaccctgctccaggcccccggagaggccgtgctggtgcctgcaggggctccccaccaggtgcagggcctggtgagcacagtcagcgtcactcagcacttcctctcccctgagacctctgccctctctgctcagctctgccaccagggacccagccttccccctgactgccacctgctttatgcccagatggactgggctgtgttccaagcagtgaaggtggccgtggggacattacaggaggccaaatagagggatgctaggtgtctgggatcggggtggggacaggtagaccaggtgctcagcccaggcacaacttcagcaggggatggcgctaggggacttggggatttctggtcaaccccacaagcaccactctgggcacaagcagggcactctgttcccctcccccttaagccaacaaccacagtgccaccaagctcacacctgtccttctcaggctggcatctcccccaccctgtgccccttttcatggtaccaggcccgcactgggggcaattgacttcctccaatccccactcctccgagacccaggagacaaacagcccttccttggggaaacttgggaatcattctggcttaaacaacacctcctcctgctgctcactcccgctgagcccactctactgccccagctccgtttctaccaccgcatcctcactgggctcactgcaggcatgctgaacaaggggcctccaaccttctgccctcctgccaaaagatctggggagtgtgaggagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactgaggagactttgggtggggtggggggctgtcccccaaagatgctcctgagtgcaagagcaggcaaggcagagtcctggggcacagccacgaggtgacctccctgtgcagagactcccgagccctactccacccagcaagctccagtccgccccatctctcccgtctaccctgacctggagatccagaagtatggcccagaagagcccttgccccgcctgtctgcccttggtggcagtggccatggccgacgccaggcccagccaccctgggactgagcctgactgcttcagacagccgacccctccttgtccccgctccacgcccgcagcctcctggtggcgctccgccctctcccgcttcctttgtgtatctcagccctacaaagaaaaacactcccactcttgtcatacctaattgttcctgctgtggtttggggaattttttttattaaataaagttttttattataagggtaatata

SEQ ID NO: 13190 - DNA, 1578 bp, Homo sapiens
atcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatcca

SEQ ID NO: 13191 - DNA, 4262 bp, Homo sapiens
actcgtctggcaccagcccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggagaactccaactgctcgaagctagagaaggcagacgtcctggaaatgaccgtgcgcttcctgcaggagctgcctgcgtcctcatggcccacggcagcgcccctgccttgcgacagctaccgcgagggctacagcgcctgtgtggcgcgcctggcccgcgtgctgcccgcctgccgtgtcctggagcccgccgtgagcgcgcgcctgctggagcacctgtggcggagagcggccagcgccaccctggacggcgggcgcgctggggattccagtggcccgtctgcccccgccccagcgcccgcgtctgccccagagcccgcatccgctccggtgccctcgccgccctcgcctccctgcggccctggcctctggcggccgtggtagcccctcggccgatccacagaccctgccgactgcttgggaccttggggcactggacaggttgaagctcttggtggcggctgctgttcccatcattaggggccagcccagtacccacacccaggccggaagccggctgtttgtgactggcgtggcagactgaaagccctggggctggggctcggctcagggaataaaaggagcgtccctgcttcacccccaacttggctggagaagaaaggacaagaggcagcagggtgaagaagaagccccccatcccagctggtggagatagttctggaactggaccccgcagctgcgtgggcagccgacacacccaccccagcactggcaccagaccagagccagagccaggacctgggcaaagtgcagccgtgcaccctgcctggtcactgctctcccagccctgcctgggcctacctcctgcccagctctgcttgggaccctctgggcatgcagcagcagtagcctaagggctctggtcacttccagggctctacagggcagcagagcagagcaaaagggtgcatatgctgggagctgtcacctccactcctaggcttttctgcctagagcagaattataggggcagtatacatccaggggtctgtgcggtggggctgggggattccttaagtgactttgggaaggatttgttttcccgagcatcaatttcacacctgggcattgcaccccaggctatgcagtctttcagtgtgaggaaggggcagaacaagaatgaggcggccccgtggcctcaaggaagcttgtggctttggaggatctgactccagcagagtctgtgccaatgtggggtgagcagggcccctgccatggagcagcaggaatttgagggatggagcaggttaaagaatgggaaacatcttcacttgtttttttttcttgcaaactactccctgctactcattgagactggttactggaagcaacttgttaagatttttctttctgggcgggcgcggtggctcacgcctgtaatcccagcactttgggaggccaaggcgggtggatcacctgaggtcaggagttcgagaccagcttagccaatatggtgaaaccccgtctctactaaaaatacaaaaattagccgggtgtggtggcatgtgccagctactcgggaggctgaggcaagagaatcacttgaacctcggaggctgaagttgcagtgagccaagattgagccattgctctccagcctgggtgacacagcaagactctgtctcaaaaaaaattttttatttctttcttttccatggaggcctagagtccctgtgaaggctaggaaggggctgctgatcccaggagtgcccacgaggagtggggggcactgttggcccataatcaggcaaacacccatcatttcatgggggattcatgaaatcatagtcaggcaaacacccgtcatttcatggctaagcatttgcagaaggtggaggattctcccccgagtccccaaatcagcagcctgtgctagggaccagagcaccgggggcaagaagacagaaccaatgtgggagtggggatggtcactaaatctgactgtgccacacaagcccatgatgaccttggcactggtttgggtggcaggatatgaaggaagctgtaggcattattgaaaaaatcattgttcagccaacagggtgaggctcccagcaaggccgtgccatcttcccacctccctgtgcccagagggttagactgtaagctcccggagggcgaggctggggctgagcgtgcctccacgtccccaaggcacagggtgcacagtgggtgctcactgaatatagtggactagtgagcagaggatgagaggactaccctgtaatgagccttggacagtctggcatttgccttaactcccactcccatgccctgggatcactgttggatatttactccatgaggacaaatactggggaggtgtggagaggagggagggcaggttcctcttactttcacccattgctgagaatgagcgcctgttggcactgcctttgtgagcctccgggagcaggtaacctgcggcccaagcccgcctaggactccacatcaggcaggcacaggactggccccttgtcctcataaaaactctcagtacagcttaaactctgtaagatctaaccagccaggaggaccctcgcttcctctccgccatgcttgccacctcttgcttctgagagtccatctcagttcgcagttctgtgacttgcattgacctggctccaatcaagctacaactcaagcagtcacggggagaaggattgtagatgggccagtgactcacagggtcaggcactcgggggagcctgagtcaggaggtcagtgggccctggaagggagggggcaagcctgggtgggtaaggttctgggccccaggcaagaaggcagagtttctccgcaggggtgtgtgcaagagctagctgcgcagaaggtctccgctggctctccaagccgggcttgtgaaataggaacgccaacatcctcctccacaggcagtggcaggcacctcctcctcaggtgccccccaagccctatctgatgggcaaaggtgaacgcagggcggtgggcttttcctgtgcagagggagactgattcaaagggtcatttatgacctttcacaagtcccacatcctgcccaatggccaggtcttgggatgctgttgcaagatggttctgtgactccatgtgactgtctgatgattgccccagctggggaaaaggctcccatgtctctttctcataaaaccagtgggcaaggccgggcgcagtggctcacgtctgtaatgccagcacttcgggagaccaaggtgggcggatcacctgaggtcaggagttcaagaccagcctgaccaacatggtgaaaccccgtctctacaaaaatatggaaattagctgggcatgacggcgggtgcctgtaaccccagctacttgggaggctgaggagggataatcagttgaacccaggaggtggaggttgcagtgagccgagatcgcgccactgcactccagcctgggtgacagagcaagactccatctcaaaaacaaacaaacaaaaaactagcgggtgaaatgattcagtgacctaaggacagccagagcactaagctgctgggaacccatctgtgctgaaatgtagatttcccaggaaactcaggcttgggacaggcgcctacctgctcctcgggcaccaggtgattaggagaggtcgaatctcatttccacgtgagtgaggataaagactgggctgccaaggaggactcctcataaacattgacaaattgctctgccccgcctgtgatcccagacgactcctgcagtctgggatcctgagtgtcctgtgggttcatctcggatgggcgctgcataaacagcctgcagggaacgtctgggagaaccagcttcacaacagatataataaggaagaagtttgaaatattgcaagaattgcgaaagtgtgacacacagatacaaagtgggcacatgctcgtgggaaaatgttgccaatagacttgcttgactctggagttaccccgaaccttcaatttgtttaaaaaaaaaaaaaggcaatatcttgacgtgcaataaagtgaactgcaataaaa

SEQ ID NO: 13192 - DNA, 507 bp, Homo sapiens
cccgggccgcgcccgggacctcatttcggacctcggtttccctttgcgtggggctcgcagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgcttcctactctacatccaggctcctgagcagcccccagcttaagcttcagcagctccagggtaaatccatctccgcccagagctgactccggatctgccccagtgacaataacaagataaatgccttccattctcttcgtacttacaggatgtaatccacatatttacacagtgtttcatttgcggtaatgtttgttttgtttcttgttccttcgtacctatctgggaagcctgtg

SEQ ID NO: 13193 - DNA, 1222 bp, Homo sapiens
cgcggggacactcgtgcgactggggcaaggtgcccaggggcttctctcctaatttgcctcacgtaacagttgagaccccagagggcagcaaaactgggttcgaattggagagccgtccaggcacagacaaattcattcatctgcccagtgcccgctaactgcggttccaggcgccggcgacgcaattccagagctgccaccgcttccccgcggagcatggggctgcctcgccgggcaggggacgcggcggagctgcgcaagagcctgaagccgctgctggagaagcgccggcgcgcgcgcatcaaccagagcctgagccagcttaaggggctcatcctgccgctgctgggccgggaggatgcttctggctggcacacctggcttcccctccatgctcagaactgcttcctactctacatccaggctcctgagcagcccccagcttaagcttcagcagctccagggtaaatccatctccgcccagagctgactccggatctgccccagtgacaataacaagataaatgccttccattctcttcgtacttacaggatgtaatccacatatttacacagtgtttcatttgcggtaatgtttgttttgtttcttgttccttcgtacctatctgggaagcctgtgcaattcagatgtccaggcccacttccagaagttctcattccctgtgcttgagtcaatggccgcagaccatacacctgagagcaagttaatctgctctaacaaagatatcacatctaagaatggtggttggcaggggctggggggtgggaagaatggggagttggtgcttcatgggtacagagattcagttttgcaagaggaaaagagctctggagatggatgctgctgatggctacaccgcaatgtgaatgtgcatgatgcttaaatatggttaagatgggccgggcgcggtggctcacgcctgtaatcccagcactttgggaggccgaggcgggcagatcacgaggtcaggagatcgagaccatcttggctaacacggtgaaaccccatctctactataaatacaaaaaattagccgggcgtgggggcgggcacctgtggtcccagctactcgggaggctgaggcaggagaatggcatgaacctgggaggtggagcttgcagtgagccgagatcacgccactgcactccaggctgggcgacagagcgagactccgtctcaaaaaaaaaaaaaaaaaaaaaa

SEQ ID NO: 13194 - DNA, 697 bp, Homo sapiens
tgggcacggagcctgctgcccggggcagcctccccggcaacttccgaaagatttccaagccgctgatggagaaaaagcgccgggcacgcatcaatgtgtcactggagcagctcaagtcgctgctggagaaacactactcgcaccagatccggaagcgcaaattggagaaggccgacatcctggagttgagcgtgaagtacatgagaagccttcagaactccttgcaagggctctggcctgtgcccaggggagccgagcaaccgtcgggcttccgcagctgcctgcccggcgtgagccagctccttcggcgcggagatgaggtcggcagcggcctgcgctgccccctggtgcccgagagcgccgccggcagcaccatggacagcgccgggttgggccaggaggcgcccgcgctgttccgcccttgcacccctgccgtctgggctcctgctccggccgccggcggcccgcggtccccaccacccctgctcctcctccccgaaagtctccctggctcgtccgccagcgtccccccgccgcagccagcgtcgagtcgctgcgccgagagtcccgggctgggcctgcgcgtgtggcggccctggggaagccccggggatgacctgaactgaaggcgctccctatttggtctcgcgacacagggactattttcagcacgcccacagtgactgccaggaccccc

SEQ ID NO: 13195 - DNA, 899 bp, Homo sapiens
ggcctgaggcgcgcgcgggcctggagccgggatccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattcca

SEQ ID NO: 13196 - DNA, 1040 bp, Homo sapiens
gggaaagaatgcggagccgggttcacacaccccgcggcggcgaggccttaaatagggaaacggcctgaggcgcgcgcgggcctggagccgggatccgccctaggggctcggatcgccgcgcgctcgccgctcgcccgccagcccgcccgtggtccgtggcggcgcgctccacccggcacggggaggcgcggggcgcaccatggccgcagacacgccggggaaaccgagcgcctcgccgatggcaggagcgccggccagcgccagccggaccccagacaagccccggagcgcggccgagcaccgcaaggtggggtcccggccgggcgtgaggggggcgaccggggggcgggagggacgcgggactcagccggtgcccgacccgcagtcctccaagccggtcatggagaagcggcgccgagcgcgtattaacgagagcctcgctcagctcaaaaccctcatcctggacgccctcagaaaagagagctcccgccactcgaagctggagaaggcggacatcctggagatgaccgtgagacacctgcggagcctgcgtcgcgtgcaggtgacggccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattccaga

SEQ ID NO: 13197 - DNA, 1306 bp, Homo sapiens
cgcgcttggccttgcccgcgcccgctcgcctcgtctcgcccggcctccccgcgtcgcctcgtcgcctgttccgcgccaggcatggcccccagcactgtggccgtggagctgctcagccccaaagagaaaaaccgactgcggaagccggtggtggagaagatgcgccgcgaccgcatcaacagcagcatcgagcagctgaagctgctgctggagcaggagttcgcgcggcaccagcccaactccaagctggagaaggccgacatcctggagatggctgtcagctacctgaagcacagcaaagccttcgtcgccgccgccggccccaagagcctgcaccaggactacagcgaaggctactcgtggtgcctgcaggaggccgtgcagttcctgacgctccacgccgccagcgacacgcagatgaagctgctgtaccacttccagcggcccccggccgcgcccgccgcgcccgccaaggagcccaaggcgccgggcgccgcgcccccgcccgcgctctccgccaaggccaccgccgccgccgccgccgcgcaccagcccgcctgcggcctctggcggccctggtgacccggcgggacctgcgggcgcgcggcccgacgaccagagggcgagcctgctcctctcgcctgtagggaagcgccttcccgccgtcgtccgccccgggcttggacgcgcccttctccggaaggctctggccccaagctggccggcccgcaggagccccattctcagagaatgtgtgtgcagagtccctgccgttttaggacaatcagggcccatcttctgccaagtgtctgaccccatggggttgttctgtgtttgcatttaagcaagtgacttctgggaagtccccggccgcccggggttctatgatatttgtagtgccggggctcgcacactgctgcccccagcctgtagaggactttcttcagggcccgtagctgctgggcgtacccctggcaggcgggctgtgccgcgggcacatttgccttttgtgaaggccgaactcgagctgtatcctcataggaaacagtgatcaccccggacgggcgtccaggaccctgagggccatggccaaaaggctcctgagtgtgcctggtggtctggctggggctcacggtgggctgtctggggagggtgggtgcctccactatgatccttaaaggattcctctgtgtgggtggatgcgtgtgggcacgactttgtactcagaaattgaactctcagtcacgtggaagccacgggactgctccgaagccgccataataaaatctgattgttcagcccccaa

SEQ ID NO: 13198 - DNA, 1454 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 13199 - DNA, 1600 bp, Homo sapiens
aagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttaccctt

SEQ ID NO: 13200 - DNA, 1286 bp, Homo sapiens
ctccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagtt

SEQ ID NO: 13201 - DNA, 1667 bp, Homo sapiens
gaggagcaatggtcacccgggatcgagctgagaatagggacggccccaagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccgggggttccccggtccccagtccaggacgccgaggcgctcgccagctgctacttgtccggtttccgcgagtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctgagccttggggggtggtgggggcggggtctaggggtggggtagagactccagcccgagggcagcagagggacccgggcgtccgggcgagcaggtgttggggagggcagtggggcgcgcgggctcagcgcgcgggtgagatgtggtctatattagagtatctatataaatatatatttccctggttcctgtcccttttccctgccccaacttctcccttgcgtctaggattgtactctctctgcccctcagcccagtcccagtcccttcccgagtccctagtgcatggaataaagtggttattaaatccccgtgtgtccccgagccaggggcctgcctttatctcgacgtccacgcccactttcccttcccttctgtctcccaccctcagtcctgctctccatggcccaagccccggggcagacaggtaagtaaagaagagagcagagcgggaactgagatcgaaattgaaaccaggtggaaagagagagatagggtagggggagaagggatgggggcctttaagaaaaaaacggataaaaaggaaaaattgaaataaaatcgactctggtgggattcgaacccacaacctttgaattgctctattcgtcactagaagtccaatgcgctatccattgcgccacagagccacccgacgaacggcggcgtcttgtagcttacgggtactagagtgggaatggggcagggttggggagcggggctaagggacttgggcgggacatgccaggagggcgcggtttggatctcagaggccaagccaggtagaggtagcgggcgcaaagcatgttagccaggtgagagagagggcgcacatgggtcgaaaaaacagggagggagagcaaccgaaaatggctgagcgagcgagtgcagagctccggctgcccgcttggggggtgtttccggctcaggcgctccccactcccagatatagtcccacccaaataaactagttttgttgtaaatt

SEQ ID NO: 13202 - DNA, 1682 bp, Homo sapiens
gaggagcaatggtcacccgggatcgagctgagaatagggacggccccaagatgctcaagccgcttgtggagaagcggcgccgggaccgcatcaaccgcagcctggaagagctgaggctgctgctgctggagcggacccgggaccagaacctccggaacccgaagctggagaaagcggagatattggagttcgccgtgggctacttgagggagcgaagccgggtggagcccccggccgccgcggctccaggggttccccggtccccagtccaggacgccgaggcgctcgccagctgctacttgtccggtttccgcgagtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgcaccagggccaccctagcccgcgctgcgcatggtccccatccctctgctccccgcgcgccggggattctggcgcgccggcgcccctcaccggactgctgccgccgccaccgccgcctcacagacaagacggggcgcccaaggccccgctgcccccgccgcccgctttctggagaccttggccctgagccttggggggtggtgggggcggggtctaggggtggggtagagactccagcccgagggcagcagagggacccgggcgtccgggcgagcaggtgttggggagggcagtggggcgcgcgggctcagcgcgcgggtgagatgtggtctatattagagtatctatataaatatatatttccctggttcctgtcccttttccctgccccaacttctcccttgcgtctaggattgtactctctctgcccctcagcccagtcccagtcccttcccgagtccctagtgcatggaataaagtggttattaaatccccgtgtgtccccgagccaggggcctgcctttatctcgacgtccacgcccactttcccttcccttctgtctcccaccctcagtcctgctctccatggcccaagccccggggcagacaggtaagtaaagaagagagcagagcgggaactgagatcgaaattgaaaccaggtggaaagagagagatagggtagggggagaagggatgggggcctttaagaaaaaaacggataaaaaggaaaaattgaaataaaatcgactctggtgggattcgaacccacaacctttgaattgctctattcgtcactagaagtccaatgcgctatccattgcgccacagagccacccgacgaacggcggcgtcttgtagcttacgggtactagagtgggaatggggcagggttggggagcggggctaagggacttgggcgggacatgccaggagggcgcggtttggatctcagaggccaagccaggtagaggtagcgggcgcaaagcatgttagccaggtgagagagagggcgcacatgggtcgaaaaaacagggagggagagcaaccgaaaatggctgagcgagcgagtgcagagctccggctgcccgcttggggggtgtttccggctcaggcgctccccactcccagatatagtcccacccaaataaactagttttgttgtaaatt

SEQ ID NO: 13203 - DNA, 2678 bp, Homo sapiens
gggggggcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 13204 - DNA, 2461 bp, Homo sapiens
ggaaagttgtgacggtcgagcttgagcctggcgggccgcggagcgttcacctgcggccgggaggcaaagtactagctctgtgattagattgaattctccaacaacaacatctcagattatggcaagaaagaaaaggagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgctgctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgacta

SEQ ID NO: 13205 - DNA, 1429 bp, Homo sapiens
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 13206 - DNA, 1300 bp, Homo sapiens
gtgtatgcatgtgtgtgtgtgtgtgtgtacatgcatgtgtgtgtggatgcatgcatgtgctgtgaagcagggagactagctttccactcctccttgtcttctctctgcagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagc

SEQ ID NO: 13207 - DNA, 1252 bp, Homo sapiens
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 13208 - DNA, 1107 bp, Homo sapiens
gctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccc

SEQ ID NO: 13209 - DNA, 1158 bp, Homo sapiens
atgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 13210 - DNA, 1077 bp, Homo sapiens
actgctcttccagaggcaagaccaaccaagatgagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 13211 - DNA, 1047 bp, Homo sapiens
atgagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaa

SEQ ID NO: 13212 - DNA, 1702 bp, Homo sapiens
gatcccgctcactcttggcgccttcgcggaaggtgcgtccgagccatggccgctgccaacccgtgggacccggcgtccgcgcctaacggcgctgggctagtgctaggccacttcatagcttcggggatggtcaatcagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaa

SEQ ID NO: 13213 - DNA, 1125 bp, Homo sapiens
ggcgtgtgggcggggcctagggagtgagcggggcgcatctcccgctaggagttcctagtaaagtggcgggagccgcagctatggagccgcaggaggagagagaaacgcaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaagccaagtatcttcaagaccttctcatggagagtgtgaatttttcccccgccaatctctctagcactggttccaggtatctgaatgctttggttgacagtgcggtggcccttgaaacaaaggatacctcgctagctagttttatccctgcagtgaatgatttgacctctgatctctttcgtaccaaatccaaaagtgaagaaatcaagattgaactggaaaaacttgaaaaaaatttaactgcaactttagtattagaaaaatgtctacaagaggatgtcaagaaagcagagttgcatctgtctacagaaagggccaaagttgataatcgtcgtcagaacatggactttctaaaagcaaagtcagaggaattcagatttggaatcaaggctgcagaggagcaactttcagccagaggcatggatgcttctctgtctcatcagtccttagtagcactatcagagaaactggcaagattaaagcaacagactatacctttgaagaaaaaattggagtcctatttagacttaatgccgaatccgtctcttgctcaagtgaaaattgaagaagcaaagcgagaactagatagcattgaagctgaacttacaagaagagtagacatgatggaactgtgacaaaagccaaataaacatccttttccctaacaaagtaaattgaataggactttacagagttctttttcctcttggcatttcctaataacaaaactttctgtgttcttagattacagaatatcataattgatagaatatggtttcttactgtgtgttgcatttttgtgcccaaatacatagttttcatattaaaaagccttttctctta

SEQ ID NO: 13214 - DNA, 3949 bp, Homo sapiens
gccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcaagtgatcctcccacctcagcctcccaagtagctgggactataggcacgcgccaccacgcctggctaatttttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaa

SEQ ID NO: 13215 - DNA, 3849 bp, Homo sapiens
gtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcaagtgatcctcccacctcagcctcccaagtagctgggactataggcacgcgccaccacgcctggctaatttttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaact

SEQ ID NO: 13216 - DNA, 5620 bp, Homo sapiens
ctcccgtgaggcagtgcgaggcgcgcggggcacggagggcggtggcggcgggctcctgcgagaagcaagcggaacttcctgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaatttgaggtcaatggaacatttaatttgatgaattgaactattatattaatttgtcttttttctcatgtagtacattcagaataccagtgctttttatgacttgagcatgtgtttagtggtacttagtcctggtaattttttacttacagggaaaaagcattattacataatgcaaatattttttaatatagttatctctctcctttttagaaatagaaattttctgccgttaaatttttttttgagatagagtctcactctgtctccaggctggaatgcagtggcacgatcttggctcactgcaacctctgcctcccgggttcaagtgattctcctgcctcagcctcccaagtagctgggactacaggcgcacaccgccacacccagctaatttttttgtattttagtagaaaaggggtttcaccatgttggccaggatggtctcaatctcttgacctcttgatcccctctcccggcctcccaaagtgccggaattacaggcatgagccaccacgctcagccgctattaaatattttaaaatgtgtagaacttctagtcagcatttttaaatctgtagaccttaatatgtgaaatagccaagtcccctcatgtttgactgtcaaataaaattctgctgctcaaattgtattcctccataattccctgctatagacctttaggctgttttaatgtccctacttgtaccacagagtattaggacttccttggcctgcctgcattcattttagagtctgaattctggggactcaaaagtttctacaagacagctgagcagtgctttgactttaatgtgacttacacatcataaatgactttcaaatgaaatttgaatttcaaaattctgtaaaagtggttgctcaaaagatgtatgatactattttaatcagtttaagagcaaaaatgtctaattgtatttaacaatggtatttgggcagccagaaaatattttaagcgttgctctaaaataatttgaagtagctcatctgttattacatcagatgcttcttgagtgcccaatttatacatggcctgtggtaaataccatgtgagctttgtaggaatacctttaagaatattcctcacctgttcgtaatatggaatgccaatctaaaaactacatgttttgggtggtctttatggaattttttagctataaccatcagaaaacaggcatacctagatgacagatgaaccttcttgatttttgaaacccattgaacaaaaatattttgccaattattgtgtttatgttatttaaaattttatgtaaaccttaattttgtagcagtaaattttgtttaagattttgctatcagctccctatcacctgagcaactttttttttgttgtatatgtttttttctattctatttcggaatagagaatttacttaaaatttttattttctccaaaaatgtggaaaatatgtcacctggtttcctggtttatggtagcatattctgtttaaattagtgtcacatatttagatgtgtggccagacgcttgatttattagttaatttttgagacagagtctaactgtgtcactcaggctggagttcagtggaatgatctcggctcactgcaacctccgcctcccaggttcaagtgattctcctgcttcagcctcctgagtagatgggattgtaggcgtgcaccactgcacctggctaatttttgtattttcagtagagacggggtttcaccatgttggtcaggctggtctcaaactcctgacctcaagtgatctacccgccttggccttccatagtgctggcattacaggtgtaagccaccatgcccctgcccagatgcttgatttatactgtccccacccaaaccttgacttgctcagcccagggggccagcagggcagatcaaggcacggatggtagttgtgtgtctgccgtaattacccaagttacttataatcgttgtgttactaggtaggtttatttgaagatttatttatttatttatttattttttattttttgagacggagtttcactcttgttgcccaggctggagtgcagtggcatgatctcagctcactgcaacctctgccttctgggttcacgtgattctcctgcctcaggcctcccgagtagctgggattacaggtgccaccatgcctggttaattttttgtatttttagtagagacggggtttcatcatgttggccaggttggtctcgaactcctgacctcaggtgatccacccgcctcagtctaccaaagtgcagggatcacaggcatgagcttccgcgctcagcctatttgaagatttaataacatttttcaaacctcaggatgtatttgagtagattgcttctaaattggtcacctagaaaataagttatctatttactatgatacctggattaagcctctagctattttgcttttttctttctatctatattattggatgattgatgcctattttctgtggttatgaatatagacattttaaatgaaagttggtatataaatttttgaaaataattgtatttcctgttttatagtcttaggattaatatatgggatttatcttatgttaatcttacatttaggattttgtgaaaatggaaaattatgaggcattggtaggctttgatctctgtaatacaccgctctccagtgttgctcagaagattatgtctgctatgcattcaggtgatttagtggattctaagacttggggaaagagtacagagagtaagtaatttttatgaacctttctttctcttgatactttgaatgttaattgttctaaagactaagaattgaaaatggaatgcatgtagacagatgaagcccagctcccgccccttttacactcattcagtgcagactgagcttctgcttgctaactttcgtgttcccttaaccttcattgctttaaaaatgtaacactctcttccttattccaggtatttctgtcaaacattcccttagaatctggatcaggtattttagtattttcaaaagagatgctttaatcttggttctcaggtcatcaaacctgtacatagtatttgctattttgtgtggtgaacaagagatatgtttttgacaatatgtgtattgtgctgctatagaaatgtaaactcttaggtggcaaggattattggatcagtgtatatggatttatgatgtggtataatagtaaaagcagtggggccgggtgcggtggctcacgcctgtaatcccagcactttgggaggccgaggtcggcgatcatgaggtcaggagatcgagaccatcctggctaacacggtaaaacactgtctctactaaaaatacaaaaaattagctgggagtggtggtaggcgcctgtagtccagctacttgggaggctgaggcaggagaatggcatgaacccaggaggcggggcttgcagtgagctgaggtctccagcgtgggcgacagagtgagactctatctcaaaaaaaaaaaaaaaaaaaa

SEQ ID NO: 13217 - DNA, 2430 bp, Homo sapiens
gtcgccttgtgcgcttgcgcgcgtccaggcgctcccgtgaggcagtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaa

SEQ ID NO: 13218 - DNA, 574 bp, Homo sapiens
gtgaggcagtgcgaggcgcgcggggcacggagggcggtggcggcgggctcctgcgagaagcaagcggaacttcctgagctcggtgtcgacggcgattcggtgggcttgtgcgtttgttttgtcagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacat

SEQ ID NO: 13219 - DNA, 580 bp, Homo sapiens
agtgcgaggcgcgcggggcacggagggcggtggcggcgggctcctgcgagaagcaagcggaacttcctgaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcg

SEQ ID NO: 13220 - DNA, 1642 bp, Homo sapiens
gccccgcctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccaggattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctta

SEQ ID NO: 13221 - DNA, 1474 bp, Homo sapiens
ggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccaggattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatatt

SEQ ID NO: 13222 - DNA, 1428 bp, Homo sapiens
cctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatatt

SEQ ID NO: 13223 - DNA, 1198 bp, Homo sapiens
ttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatatt

SEQ ID NO: 13224 - DNA, 1447 bp, Homo sapiens
gggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctta

SEQ ID NO: 13225 - DNA, 1637 bp, Homo sapiens
cctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgattatctcctgaataaagttatgatattatatctt

SEQ ID NO: 13226 - DNA, 652 bp, Homo sapiens
gggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggc

SEQ ID NO: 13227 - DNA, 983 bp, Homo sapiens
cacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcag

SEQ ID NO: 13228 - DNA, 1107 bp, Homo sapiens
gagtgtggccccgcctccacctccttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgag

SEQ ID NO: 13229 - DNA, 1454 bp, Homo sapiens
ctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattgtatttgatt

SEQ ID NO: 13230 - DNA, 1626 bp, Homo sapiens
ttcgtcgcggcctctagtgcactttcggctccttccccttcccgggcctttcagcttggtctttccgggcctcgcttcccccagcccctgcgcccggcccgaacgagaggttccggagccccggcgcgggcgggttctggggtgtagacgctgctggccagcccgccccagccgaggttctcggcaccgccttgagagcttcagctgccccagggtgtgcaggtttgctttagagggtcggcgggcggagcttcggggaagaggagctctgggagagtcattccggccagtggccggagaccgtcgtcgctcttgggaatccttggccgcccagacagaagggaagtaggcgccggagagcccgttctgcattttgattcatctcgggccctattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaaggattttgtgtggatgagggctcggctacagcaagaagtagaggagcagctcaaaaagaaatgtttcactctgctctgctactatgatcccaattcagatgctgacagtgaaaccgtgaaggcagcaaaggtgtggaaactcgcagaggtcctggtgggtgagcagcagcagtgccaggatgccaagagccagcagaaggagcagatgttgctgctggagaagaagagtgctgcttactcccaggtgcttctccgctgcctcactttgctgcagaggcttcttcaagaacaccggctgaagactcaatccgagctagaccgcatcaatgcccagtacctggaagtcaagtgcggtgctatgatccttaagctgaggatggaggagctaaagattttgtccgacacttacactgttgagaaagtggaagttcatcgtctgattagggaccgtttggagggagccattcacctacaggagcaggacatggagaactcaagacaggtcctgaactcctatgaggtccttggggaggagtttgacaggctggtgaaagagtacaccgtactcaagcaggcaacagagaacaagcggtgggccctccaggagttcagcaaggtctaccgttgagctctggcagggccaggagacatggcttctgcatagctgctgcctcctaatcttcctgctagtgggaccaccttcacctggggctgccttcagtacaagggagtgtggaaatgcttacgcttgaaacactgcagtcatttaggcactctcctggtttctctttattttttatgactgggcctcttctggaaaatctagcaaggagatttatataatttttatgcatagctgtgtgtcagtgtcagccctgtattg

SEQ ID NO: 13231 - DNA, 582 bp, Homo sapiens
tcccccagcccctgcgcccggcccgaacgagaggttctcggcaccgccttgagagcttcagctgccccagggtgtgcagattagaatcccaagaaaatcaaatggcatccggggatttctgctcacctggagaagggatggaaatacttcaacaagtgtgcagcaaacaacttcctccttgtaacctgagtaaagaggacctgttacagaacccatacttcagcaagcttctcctgaatctctcacagcatgtggatgagagtggcttaagcctcaccctagcaaaggagcaggctcaggcatggaaggaagttcgactgcataagacaacatggttgaggtctgagattttacacagagtcattcaagagttgcttgtggactactatgtgaagatacaagacacaaatgtaacttctgaggacaaaaagtttcatgagacccttgaacagcggctgcttgtaactgaactgatgcggctcttaggtcctagccaggagagggagatacctccactgctggggctggagaaagcggaccttctggaactcatgccactctcagaggattttgtgtggatga

SEQ ID NO: 13232 - DNA, 4309 bp, Homo sapiens
cgccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccagaccccaggccccggaccagtcagactccagccagaccctgccgtccatggttcatctcatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttctagtttgtatagtttctttttttacatgtaaatcagccatttggaatttatcctagcacatggatccaattttgtcttattttacatatatcctagtagcacttactgaaattcccagtcagagtggcagttgcctctgagggaaggtgggtggcagggatcaactgaggaggagacacagaaatgtcctagctgatgggaatgtgctgtgtcaagagcagcggcggtgacgcaggtgtagagatttgtcagagctcatgtagttgtagtcttaaggcctgtgcatttcactgcgtgggttactcaatttataaagcaaagcccttacacttttgagatgccacctttttatgcactaaatttccatgtttaattgggttatatctggcttctctccagacctgctttgtatttaactctccatgtgtcattcctacagtagcttaatagaaaggcttgtgacacattgtcatatctgttcttgttttcttttgttttttttttttttttttttgagatgcagtctcattctgttgcccaagttggagtgcagtggcatgatctcagctcactgcaacctccgcctcccaggttcaagccattctcatgcctcagcttccccagtagctaggattacaggtacgcaccaccacgcccagctcatttttgtacttttagtagggacggggtttcatcatgttggccagactggtctcgaactcctgacctcaagtgatctgcctgcctcggcctcccaaagtgctgggattacaggcatgagccaccgcgcctgaccacattgccatatctgaaatggctggattctcttaggtgcttttctttttctttctttctttctttttttgagacagaatctggctgtttcccaggctgaagtgcagtggcatgaactcagctcactgcaacctctgcctcctggattcaaacaattctcatgtctcagcctcctgaatagctgggattacaggcacccaccaccatatctggctaatatttgtattttttgtagagtcggagctttaccatgttggtcaggctgctctccaactcctggcctcaagtgattctatcgcctctgcctcccaaatcttcacctgctgggattagtttcccctgtctcagtaaattttttttcccaaactaagtgaacattagatttaatttggctggccccagaagaaaaacatgcacagatggtagttttactggtgttgcagtaagttttcaaatttggaagtttggcagctttatgatcttgaaccttgctgtccatctctcacacaactcctctcttggcctccagagtccctttactctcccagctttcctcctgcccctggctgctgtttcccagcctttccacattggctttcccatgtagtccttagtgtgtctgctcctcctctctctcctcatcacagttcccagcccccaccttcaactgaactcaacaaaatcttcaacttcatacagtagtcacattgttagtaataacactggcatttttattttgataaaatagaccgtttaaatttttgagattctaccttatattttttgaattatatactaaagcaaataagtagtgatgtaatgtcattggggaccaagatttttagtgtaaatgaaaaaagataacaaatataaactcaagtaaacaccctgtagtctttcacatgaattggaaatatcagaataaagtcatgatttttctctttct

SEQ ID NO: 13233 - DNA, 2477 bp, Homo sapiens
ggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctggaagctgctgtgacccgcctgcgggcagaaatccaggaactcgaccagagcctggagctgatggagcgagacactgaggctcaggacacggccatggagcaggcacgtcagcacactcaagacacccagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacagcctgcaccctccgggcccagttcctgcagaacctcctgcttccccaggccaagaggggcagcctcccaacccctcatgatgaccactttggcacttcgtaccagcagtggctgagctcagtggagacgctgctgacaaaccaccccccaggccacgtcctggctgccttggagcacctggctgcagagcgggaggcagagattcggtccctgtgcagtggggatgggcttggcgacacagagatatccaggagggctggcggactgtgggtgtgctggtctcccagcggagcaccctcctgaaggagcggcaagtcttgacccagcgcctccagggcctggtggaggaggtggagagacgcgtcctgggatccagtgagaggcaggtgctgatactggggcttcggcgctgttgcctgtggacggagctcaaggccctgcacgatcagagccaggagctgcaggatgcagctgggcatcggcagctcctgctgagggagctacaggccaaacagcagcggatcctgcactggcgccagctggtggaggagacccaggaacaggtccgcctgctcatcaagggaaactcggccagcaagacccgcctgtgccggagcccgggggaggtgctagctctggtccagcgaaaggtggtccctacatttgaggcagtggcaccacagagccgggagctgctgcgctgtctggaggaggaagtccggcatttgccccacattctgttgggcacgctgctgcggcacaggccgggagagttgaagcccctgcccacggtcctcccatccatccaccagctgcaccccgcgtccccaaggggctccagcttcatagcgctgagccacaagctggggctgcctccagggaaggcctcggagctgctcctgccggcggctgcctctcttcgccaggaccttctgctcctgcaggaccagcggagcctctggtgctgggatctactccacatgaagaccagcctgccgccaggccttcccacccaggagctgctgcagatccaggcatcccaggaaaaacagcagaaagagaacctggggcaggctctgaagaggctggagaagctactgaaacaggcactggagcgaatccctgagctgcaggggatcgtgggggactggtgggagcagccaggccaggccgccctctctgaggagctctgccagggcctgtccctgccccagtggcggctgcgctgggttcaggcccagggggccctgcagaagctgtgcagctgaagagagggttcaaacggaagccgagaacttgacactgttcaccccaacacctcacctcccccaggacatttggaagaaagcagcgccaggattcctcggcagtcgtccccacccgcacctgcagtcccctcatgtgctgttctgctgccccactcagctcctggaccctgtcctttcatcccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggccacactgcccaggtcgtgctccgtcaaggggtgagcaggagcaacaggggtggctgagtaagggcttgcagctggaggcaacagcacatgcaaaggccctgagccaggatgtgctgcaataagggccactgagggggacagtgtaggttgggggtgaggaatgtattaaaagatgagattgccttct

SEQ ID NO: 13234 - DNA, 3756 bp, Homo sapiens
gcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaagggtaaggtttaaatagacctatgcatattcacctgttgaagttttctctcaacttttgataaaaccagtacacaaagaatgctgcatgacctttattgttaatgtgctcccccttccttcatttaggatgaggggaatgatccctcactggacaggtcctttcagaatctctgtttatgtatatatagttacaattgatttgagacaggggtgggaaaaaaaagcccccccaatctgaagcttacaggttttataatacaaatgactgaaaagtaaatgtcatcaaaatcttgcccagtggaaggtggtttttaaacacttgagaaacccaattttaaatatcatcactataatggtgtaatatctgggggtggggtgtagaaataaaagaagccaggtcagtgtattagtttcctagggctgccataacaaagcaccatcaagtgggtggcttagaacagcagaaatttattgtctctggagacagtaagttctagaggctagatgtccaaaatcaaggtgttgacagggccatgttccctctgaagccactagaagaggatccttctttgcctcttctagcctctggtagcaccaggcattccttggcttgtggcagtgtaattctaatctttgcctccattgtcacatggtattcttcccttgtgtgtgtattgtcttataaggacacagtcatattagctaattaatgggtcaccctactccagtatgacctcatcttacttagctaattatatctgtaatgaccacatttccaaataaggtcacattctgaggtactggggttagaacttcaacatatgtttttgggggtattcagttcataacagttagtattaataattattgaagctaggtgatggatatattgagttaatcacagttctcttcacttttgtatgtttgaatgttttcctcataaaaggttaaaaaaattgctcttgtagctcattaagagagataaggatctggtgatacagattcattacatactctgatttgcccataatagttatacactgccatattgaaaagtatttggctgggcacagtggctcacacctgcaatcccagcactttgggagtccgagatgggaggatcacttgaacccaggagttcgagactagcctcagcaacacagggagactatgtctctacaaaaaattaaacaattagctgggcacgttggcgcatgcctgtgatcccaggtacacaggaggctgaggtgggaggattgcttgggcctgggagtttgaggctgaagtgagctgcgatcgtgccactgcactccagcctgggtgacagagcaagaccctgtcgca

SEQ ID NO: 13235 - DNA, 6536 bp, Homo sapiens
agaaacccgaaggcccgaggatctgggcacgacagcggttaagcaagcgcagagcaagtcgctggccgcgcaatgcccggtgggtcttgcagtttcttggctgggcatggccggaagggaggagagaaggacgcattgcatggcgggagatatagtctttgccggaagtccctcctccctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcgctttctttctttgcagccaccgtgcctaccgcgaggatgagctcggcctcggtcaccgctttcgagaaggagcatctctggatgtatctgcaggcgctcggcttcgagccaggcccggcaaccattgcctgcggaaagatcgtgtcgcacacgcacctcggagtgaacatgtttgacaagctgaaccgtgatgcctttcatataatttcttattttttgtttcaagttctggaccagtctctcaccaaagaagttttcaaattttgttggcccccatttgaccaaaaaagtgacactgaattccgaaaacattgctgtgaatggataaaaaggatttctggtgaatgtggaagtagctttcctcaagttgttggttcactatttctttctcctggtggtcctaagtttattcatctgatgtatcattttgcaagatttgttgcaatgaaatatattaaatccaattctaaaaattcttctcatcattttgtagagacatttaacataaaaccacaggacttgcacaaatgcattgccagatgccatttcgcacgtagcagatttttacaaattttgcaaagacaagattgtgttacccaaaaatatcaggaaaatgcacaattatcagttaagcaggtacgaaacttgagatctgaatgtataggattggaaaaccaaataaagaaaatggaaccctatgatgaccacagtaatatggaagaaaaaattcaaaaggttcggtctttgtgggcttcagtgaatgaaacgctcatgtttttggaaaaagagagagaagttgttagttcggtccttagtcttgttaaccaatatgctttagatggaactaatgttgctattaatattccaaggctcttacttgacaaaattgagaaacaaatgtttcagttgcacataggaaatgtttatgaggctggaaaactgaacctcttaacagttattcagttattaaatgaagtcttgaaggtgatgaaatatgaacgttgtcaggctgatcaagcaagattgacggtagaccttcactaccttgaaaaagagaccaaatttcagaaggaaagattatcagatctgaaacatatgaggtatagaataaaagatgatctcacaactataagacattctgttgttgaaaagcaaggagaatggcataaaaagtggaaagaatttcttggtttgtctcctttcagtctaattaaaggttggactccatctgtagatcttttaccaccaatgtctcccctttcgtttgatcctgcctcagaagaagtgtatgcaaagagtattctttgtcagtatcctgcttcacttccagatgcacataagcaacataaccaagaaaatggttgcagaggagacagtgataccttgggagcgctacatgatctagccaacagccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaaacatgtgctgaccagtcacatagatgaaccaccaacacaaaatcagtcagatttgttaaataagaaagtaatttgcaagcaagatttggaatgtttagccttcaccaagctttcagaaactagccgaatggagacattctcccctgctgtcggcaataggatagatgtgatgggtggcagtgaagaggagtttatgaaaatattggaccacttagaagtttcttgtaacaaaccttccacaaataaaactatgttgtggaattcttttcagatatcaagtggaattagttctaagagttttaaagataatgattttggcatattacacgaaactctcccggaagaagttggtcatctaagttttaatagttccagtagttcagaggccaattttaaactggagccaaatagtcctatgcatggtggcactcttctagaagatgttgtgggagggagacagactactccagaatcagactttaatttacaggctcttcgcagtagatacgaggctctgaagaaatctctttccaagaaaagggaagaatcttacctctcgaattcccaaacacccgaaagacacaaaccagaattgagccctactccccaaaatgtacaaacagatgatacgcttaactttttggacacctgtgatttgcatactgagcatataaagccatctttacgcacgtccatcggtgaaagaaaacggtctctttcaccactaattaagttttctccagtggaacaaagattgagaaccacaatagcatgtagtcttggagaactacctaatttaaaggaagaagacattttgaataagagccttgatgcaaaagaaccaccgtctgacttgacaagatgaagacgtacccatttaatataactatgatgcacttaaattgaagctatgccacaggatagaaaatgaattacaacttaaatacatgttggaagtgtaacactgtttttcaaggtttaaaaaaattcctaatgccttttagccttctttaatatttttaggtaaggaaagtatgtttggattttttcctctttgtaggtatatgagattgaaatgtgaagtatttggacaacaaacgtcaagcaatgggaagccattttgatttcttgagtaatcttgtaagcattaagtgaatgacaaagtagtagtgtaacttatttcttatgttataacttcagtcaattaatataaggatagtttttgttgtatgttcactaaatggttaatataatagccattgaatatactaatctttcatcttagagaactatacaacttttattgtttcttaatggaacattctggctaaccagaaaaagtgagaaaagtagtaccttgggatgtgtagtcaagatgacaaattttaagactggaaaagctctaaacaggcttaatgattcttcaggtagaatgatcctgagaagtgatgtttgatggaataaagtgcatgtgatgattaagtgaagactggggcagaatgatttaaaaaaaggaaaaagatggaagatgagtagacacttgcaaggaacactgtcaaactataaatccattcagtgggttgtataacatttatatttagtctaatttagactttgataatttaatgctacttttatattttaacaaaaatataaattaaaattttcattagtctgttttgttgttgggtttttttgtgaggtactccctgttgggggaaaggaacaaggaacaaccatcagaatcccccagtccctacagaatagcctcacagtaacttgagaaaactgaacttggggttaaataacttgtcacacttgcagtctcctgcctcactccttcaggtgccctgcctagaaaaagacttgtgtctagcatccaagtgaacacatactattgccctctgtgaaccaggaggaatggaacaggcaatggaagggtgatagtacctacaataccctttgtagaccccatctcactaccatcaaaatcttgtccactagcccccaaaaaactggcaaggaaagaaggtggaggggaaatttatggaagtagatggcttaatagttatttcttttatcttgggctgcctttctctaagttggttgtcctgtcccagtgtgaagacccatctttttgtgagaaaagacaaaagaaagcacatgtaactaccttctttgcaatggaaaaggagaaagaaaaaatcttctcctaagttgctgttttcttttattagttaataaaacaaatcagggactatgcaggtctatggggaaacctttagtctgctttaagaaaactcagtatctgaaaatcttaacttagcatgtgatactgtcttatcagcatctgcagaagtgccaaagccactgctagacacttaatgtgtattatttcatttaattatattttaaatgtgcttccttggtaattcttaagctcgagaaagagtttgagaactgctgctaggaaatagagattcacatttaaccctgtggtacttttaagaagcaggtacgttgttgcatatatacttgggtagagattggtaactatctgatagggaagctcaagttggccacccaagtctgagaaacccttaattactgagaatcaaaagagcagaatgtctgtagacattttggatttgtaaaaatcacattgttgagttatacctgtgatgggctgaaagtttttggcattctttcctgttcttcatatgccagtaccataaacaaaaagtatctcagatctgtcactttcttctcctaaaccaatgtgatggcagctttttgccttcagccttttccctatccagtatctcctacatagttaccttttgatcttaaggaactgttttgattgggtcacttccttgcctaaaattccattgattgttcattgttaattctaaaatagagttcaaatttaaaggcatgtaagttcccctgtaacggatttcctctactcccccttccgctgtaatctcccatttttttactgaaatgcttcagtgagcatgggtctttagaggtcttgatatacaattttcctgaagcaggaataccttgctttcctctactagtttaccacaattacagctctcttttaagcctcagaaaaaaatctcacttccgtcttgaagtcttaatccacgctttttatatccatgtgcctactccttctctgaaatctcctatggtttatctttttattcatttaatatcccacgaattgattttattatatattttttatggttgcatgtggtctttctagttatagcaatatacacatacatgcataaatacatatacacctatgtaaatgtgtgttgggagtatgtattcacacacatacatataccccaaggccatgtgtcatctttatcaatatttaagttttggaattgttttgtttgcctcctatatcatggaataaatggtaaagagggctaatttattactctaagtggatttcttattacattaatatcagacatatagaatgtactttgttttactatttgtaagatacaaaggtatataaactgacatacatcagcttgaaacctgagataatgctaaaatgttctaattattttaaatgtttaaagaggacaaccatgtaatgttgctaaacatgaaaaatgtcatcaagtggaataaagaatagctgaagttaacatttgggggaaattgagctgaaaacaaaaatatgagtattttgataccttttctttaccatgagactcttgactatgaagtcaaatttatctaaaggaaaaacaggaattctggagacctgtgtaaaagcagactattatcttcctactgtgagagtactaaaattaaaatacgtttaatgacgttttcctcaatgtaaaagcattgaagtaaatgtttcttttatgttgcagatacatagttgctctagagatcacctttttctttatgcattgtgaatagcagtctgcatcctaagtttaaaatatttgagaatcctctatgggactctctgtaaatgttttaaatactgttgttttcaataaatattttatacta

SEQ ID NO: 13236 - DNA, 680 bp, Homo sapiens
ttctcaagtggcatttactcatcgattccatcaatccatcaaatagttaacatccctgcctctttcttgtcgcagtcagtttcatcatcagatagaaacagtgttacagtacttgaaaaggacacaaagatgggaactcccaaagaaaaaaatgaagcaatttctaagaaaataccagaatttgaagtggaaaattctccattatcagatgttgcaaagaatacagagagtagtgcatttggagggtctttgccagctaaaaaaagtgatccatttcaaaaagagcaagatcatctggtagaagaggttgccagagcagttttatctgattcaccacagctctctgaaggaaaagaaataaaattagaggaactaattgactctctgggttctaaccccttcttaacaaggaatcagattccccgtactccagaaaacttgataactgaaattaggagctcatggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactgtatcagattttggccagtctcatttgactgaagagaaagttatttcagattgcgagtgtgtgcctcagaa

SEQ ID NO: 13237 - DNA, 1363 bp, Homo sapiens
gctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaagc

SEQ ID NO: 13238 - DNA, 1284 bp, Homo sapiens
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatag

SEQ ID NO: 13239 - DNA, 1877 bp, Homo sapiens
cgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaagc

SEQ ID NO: 13240 - DNA, 2124 bp, Homo sapiens
gagcatgcgcctgggacttgcaatgatgaaacagggccattggcaaagctggggtaccagtcacccagccacgctctagggtggtagccaagaagacggaccccgagcgggaggcagagagacaagaggtggatgaagcagagcaagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgaaatgacgaagctgggccacgagctgatgctgtgtgcgccagatgaccaggagctcctcaagcccttgtggcccgagagtttctcccgaggtccctcatctaccctgcgagatttattcacgtgaccaatggcctatgacacagccccaggaggtcctgagaacatgtgcacaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtctacgacgacgagctgggcgagtgctgccagcgcccaggccctgacctccacccgtgcggccccatcatccaggccacgcaccagaatctgacttcctacagccaaatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatgctgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttct

SEQ ID NO: 13241 - DNA, 1043 bp, Homo sapiens
attggcaaagctggggtaccagtcacccagccacgctctagggtggtagccaagaagacggaccccgagcgggaggcagagagacaagaggtggatgaagcagagcaagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagggctgctggcagggtgatagcagatgatggcacgaaggtcctttaggacatggccagatgggagcgaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgcc

SEQ ID NO: 13242 - DNA, 1454 bp, Homo sapiens
gcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagcagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattg

SEQ ID NO: 13243 - DNA, 1451 bp, Homo sapiens
gcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtgccaagaagaaggataaaagagttcaaggtggaagagtgattgagtcccggtatctgcagtatgaaaagaagacaacccaaaaggctcctgcaggagatgggtcacagacccgagggaagatgtctgaaggtggaaggaaatccagcctgctccagaaaagcaaagatagcagtggggtcggaaagggtgacctgcagtccacgttgctggaagggcatggcacagctccacctgacctggatctctctgctattaatgacaaaagcatcgtcaaaaagacgccacagttagcaaaaacaatatcaaagaaacctgagtcaacatcattttctgcccctcggaaaaagagcccggatttatctgaagcaatggaaatgatggagtctcagacactactgctgacgctactatccgtaaagatggagaacaatcttgctgagtttgaaagaagggcagaaaagaatttattaataatgtgtaaggagaaggagaagctacagaaaaaggcccacgagctgaagcgcaggcttctcctctctcagaggaagcgggagctggcagatgtcctggatgcccagatcgagatgctcagccccttcgaggcagtggccacacgcttcaaggagcaatacaggacattcgccacggccctggacactaccaggcacgagctgcccgtgaggtccatccacctggagggagatgggcagcagctcttagacgccctgcagcatgaactggtgaccactcagcgcctcctgggagaacttgatgttggtgattcggaagaaaatgtgcaggtgctggacttactgagcgaactcaaggacgtgacggcgaaaaaggaccttgagctccgaaggagctttgcccaggtgctggaactctccgcagaggcaagcaaagaggcagccttggcaaaccaggaagtctgggaagagacccagggcatggcgccccccagccggtggtatttcaatcaagacagtgcctgcagagaatctgggggagcacccaagaacacgcccctgtctgaggacgacaacccgggtgcctcgtcagcccccgctcaggccacgttcatcagcccaagcgaagatttttcttcaagcagccaggcagaagtcccgccctctctctctcgttcagggagggacttgtcatgactcatggttacattcaggatacttgagcactttatatactaccgtagcactgtagctattttttatgtgataatcttgtttgataaaaaagtaaacctgttttgcaattg

SEQ ID NO: 13244 - DNA, 2793 bp, Homo sapiens
tgaccctgaggcattgccgtcgcgcggtgcacagctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggagtcttattttcttcttctgaagtttcagctgataatgttcaaagttcttatcctcagtcagcaaatcatttggattatagtagcaaaccctttgattttgctagctcagtaggaaaatacggattatctcataattcttcagttccaactcactgtttactccatagaaaaaagaaacttgacacacgtaaaagtgaaaagaaactagaatcatgtaagttaacaaaagaactttcactagctaacctaattcatgatatgtcaagagattcctgtgaaagtcagccatcagtcagattatcatctacagacagtctggaaagtctgctttcaaagaacctagatgccgatttgttgagacctcatgcatctgaatgcatttccaaagatgattctgcattcaaagaaataccagatttaaagaccataatcataaagggcacaacaccgaataattctttatatattcaaaataattcactgtctgattttcaaaacattccagtacaggacagtttaggaagttcaaataatcctttgtacttaactagctcgttggaaaatatgactgttgataatttaaatgctagtaaagaaactgaagttggaaatgtttctttagttgaacaaagtgccaagaatcacacttttaaaaatgataatttgcagttttctcagtgtgaaagtccatccctaactgaactgtttcaggaacacaaagaaaacaatataagccagtgctttactttatctgacctttgtaaccagtcatctgccagtttcacagatctaagtttgggatcctttcccctgtcacaattagcaaatcgctgtcagtcttcacccggaatatcagaattaacaggatctctgtcgtcattggcatttcataaagcttctcccacaagagaccttgagaatttgtcactttctgaattgattgcagaaacaattgatgtagacaactctcagattaagaaagagtcctttgaggtcagtttatctgaagtgaggtctcctggaatagattcaaatattgatcttagtgtccttataaaaaacccagattttgttccaaagcctgtagtagacccatccattgctccatcatcacgaactaaagttctaagttcaaagctagggaagaattccaattttgctaaggataataagaaaaacaacaaaggctctctgactaggaaaccacctttttctctctcttggaccaaggcccttgctgctagaccttcagcttttgcctcaacactgtgtcttcgttacccactgaaaagctgcaagcgacgcacccttgacctctataagacttttctttatagtagacaagttcaagatgtaaaggacaaagaaataagtccacttgtagcaataacaccatttgacttcaaatcagcatcacctgatgacattgtaaaagctaatcaaaaaaaagcatttactagagaatagtaacaaaaggaaaacttgattgctgttgtagagctttttatttttaattaaagtcttcagaggatcactttatattatgggattcaaattctgatttttatgaaaattgtcgtaggtcagttgattagttgatacgtatttttgcactgattttttttttaactatgtcttctttcagtgataactggctttatttaagttggtaacctatactgagtatatgtttacaaagtggatatggaaacttgatgttgtgaaatcagacctcatatatttttgtttgaagcattcaactttctatgttttttataatgaaatatttttttctatgaaatatttttgtgctttgttcttaaacgaaaatgccagcacttgggattattatagtttagtgtgaagattattcttatgtggcacagcataactgagatgttatattttaaaatatgatataattcctagtttcattatttttctgtaaatactaaaatttttctattagaaaatcttaaaattcctgacttttgagagtactgtggagattgttgaaatacatttttgataataataaaatgaaaatcttttaagggaccatgtaaatatagaagttggattaatatgtgaattatttttatacatttttaaaaaccatttgtcctaagtatacactttaaaataaatatataaaaagtgttttcaag

SEQ ID NO: 13245 - DNA, 2102 bp, Homo sapiens
cagtctgtagaggatgattattgtatttcgccgtcaacaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagc

SEQ ID NO: 13246 - DNA, 2703 bp, Homo sapiens
gcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcat

SEQ ID NO: 13247 - DNA, 7163 bp, Homo sapiens
agggaggcggacagtgaccctgaggcattgccgtcgcgcggtgcacagctaagacgtcgcgcttgcgcaggcgctcggcgcagaggcctgcgggaagccaagatggcgcataggggttctccaggctgcagttggcgccttatcagtatctaagcggagtgttttggaaggagttaaggggctgtggcaaacgccctctccgccgtcatggcccggcatcggaatgttcgaggctataactacgatgaagattttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatggcttaacatatacaacagcatttcttctccctgcaccttttcgtgaacctgacattttgaacataagcaataacatctgtatggtaaagtaggcagattatacatgtgttgcttagtgaatgattaccaagtgaacacacttggtatattgctttaccaaaatacatgtgtagttgtcacttcagattcactgagttaagaaagttttatttaaatattaatattaatcaagaatttaacagatatatgtgacagaaatctaacttcaagtgactgaagcagaaagaaaaatttttgaatgacataactgagaaaattagaggtagctctagctttgattccatttagatcgagcagctcacacaatgttagcaaggactcatctccactctgccttccctggtgctggttttgctctcaaactctatatagaactctcggccgggcgcggtggctcacacctgtaatcaaaacactttgggaggctgagtcgggaggatagcgtgagcccaggagtttgagaccagctaaggcaatatagtgagaccatgtctctacagaaaaaatttaaaaacagatcagctgggtgtggtgccacatgcctgtagtcccagcttctcaggaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacatcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtgtgagggttggaaattcagggtgctgttaggaaggggaaatggattggggtttaaggtagggggagtaaaaacaagaaaccatccactctgtatattatataagactgtgatcgaattaagaattttagtttacagtttagcataaacaaatagtagtagaaatgaatgcatttattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacatgcccaagcttggttatgctctgatttcctaccctgttactttcatccataatttatagtacatccattttgtgtcattttgcttcaggtatttcttgtcctgactgtcttcttttttatgattttactgtttcttcacactaatggctttgtcctctgactttgactctttgtgagattcttctgagcagttaacctctaggataatgtggcttgaacacattacagaactatgttttgacttgttagtattattcacacattcatgacaattgagcctctctactgtgagaaatgttttagaggccagtttctaggcatagctgtttttctcccatgagtatgcaaatcaatagttttaaccattgttaaaatgcaatcatagtgacttcagaaaatttggaaaatacagaaaatatagggaagaataaaattaacccacagttctgtcacctaaaggtaactgctgccaatgttttcatgtatttcttttctgtctctccaatgcatttttttacatagttgtgagcgttagccaagttattttcatgttgttatgtaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagcaagggtttcttctggattgagtgctgtcagaaagtggattgagtgctgtcagaaagtgggagtgattttgcaactgggtatcttaatttttatgttgtgggtgggaggaaaggaaagaagcaacagtcacccatgttagccacaagaagaggttggctgtttatggtttgcacagtgactttgtttttatctgtgctcaggcatgattacagtatctcattttatccggattacagtgacctcatctgatgttagagatttgagaattgttaaatgttcagcaggagaacgccaccgcctagtgtgaatgctaggtcagaagctgctttttcacactgaaaccatttaagtatgtacaaataagttaatagtgtaaatgtaggtgtaaaatacaatgcaaaacaaaataatgaagtaagtgaattaaattattgcaccaaatatggggatatgaaatagggaaagaaaagcattaagttacttatagtccataaagggactacattattttgttactctgataatcccataaaacaaagttttaagaatgtttacagtaaccatgaatggaattagtgaaactattcatatcaatgcaaaaaaaaaaaaaaaaaaagcaaagaaactaagtctgtacagcaaaagatggaaaggaaacaagaaaattaaatgaagacaaaggttgtgattattacagtaaatgaaaataggtttttatctttaaaatgtagactcaaactgcaaagctaatgatatgctatctgcaaaatattcctattttgtaaataaataaaaccatagatttaaagaagaaagggcacagatgtactggggagacaaaaataactgatccgttgggtgtataccatgtgccaagcaattttcatatactcatttaacatgacatatctataattatatgaggcagatattattaacctcagtctatagatgagaagactaaagctcagagggattgctaaaaactagtaaataaattatggaaccatgatttgaatttagatttaagtctgactgaggcatgttcagagacactacactgcctctccagaaatcaggagtagcaatattaacactggacaaagaatttaaagcaagtaaaaaaaaattaagagaatttcatattaataacaagtataatgcacaataaaactgtaccaaatgacataaaaatgcataatgaaatttattagaaattaaaaattaaagggcatagttacaattattgaggaattctcatagctctgccttatagatcatgtaaacaaacaaggtcatagaggacttaaatagcaaagcagaaaaaaa

SEQ ID NO: 13248 - DNA, 1585 bp, Homo sapiens
ttgaagatgatgatctctacggccagtctgtagaggatgattattgtatttcgccgtcaacagctgctcagtttatttattcacggcgtgacaaaccttccgttgagcctgtggaagaatatgattatgaagatctgaaagaatcttccaattctgtttcaaaccatcagctcagtggatttgatcaagcagctactcaacttagtggtcattggtcatgttgatgctgggaaaagtactctgatgggccatatgctttatcttctgggtaatataaacaaaagaactatgcataagtatgaacaggagtctaaaaaggctggcaaagcttcgtttgcatatgcatgggtcttggatgaaactggcgaagaaagggaaaggggagtaaccatggatgttggtatgacaaagtttgaaaccacaaccaaagttattacattaatggatgctccaggccataaggacttcattccaaatatgattacaggagcagcccaggcggatgtagctgttttagttgtagatgccagcaggggagagtttgaagctggatttgagactggaggacaaacacgagagcatggactcttggtccgttctctgggagtgacgcagcttgcagttgcagttaataaaatggatcaggttaattggcaacaagaaaggtttcaagagattactggaaaacttgggcactttcttaagcaagcaggttttaaggagagtgatgtaggttttattcctacaagtggtctcagtggtgaaaatctaatcacaagatctcagtcaagtgaactcacaaaatggtataaaggactatgtttattagaacaaattgattcctttaagcctccccagcgatctattgacaaaccttttagattatgtgtgtccgatgttttcaaagatcaaggatctggattttgcataactggtaaaatagaagctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtggccccaaagtacccattaaagcttgcactcgtttcagagcccgaatcctcatctttaatattgaaattcctatcactaaaggatttcctgtgctgttacactaccaaactgtcagtgaacccgccgttattaaacgattgattagtgtcttaaacaaaagcacgggtgaagtcacaaagaaaaagcctaagtttttgactaaaggccagaatgcattggtagagctacagacacaaagaccaatagctcttgagctatataaagactttaaagagctggggaggttcatgctacgttacggtggttctacaatagctgctggtgttgtcactgagataaaagaatgatgggtcagaatttctaccacgtttctggatacagtgaaatagctaacctctgtttcaagaatgcagttattaagtcaaaggaacaatgtgcaattgatatgtttttagatgagag

SEQ ID NO: 13249 - DNA, 1227 bp, Homo sapiens
aaagataaagcctttcaaatttgaggaagaccttcggtcccgcctccatttcacgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgctaa

SEQ ID NO: 13250 - DNA, 914 bp, Homo sapiens
agtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccac

SEQ ID NO: 13251 - DNA, 1151 bp, Homo sapiens
gctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgct

SEQ ID NO: 13252 - DNA, 2370 bp, Homo sapiens
ccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccgtggaccccctgaagctatttgatgatcctgacctcggcggggccatccccctgggtgactccctcctgctgccagccgcctgtgagagtggagggcccacacccagcctcagccacagggacgcctccaaggaactgttcagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggcctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaa

SEQ ID NO: 13253 - DNA, 2780 bp, Homo sapiens
agctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaa

SEQ ID NO: 13254 - DNA, 1337 bp, Homo sapiens
atgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatga

SEQ ID NO: 13255 - DNA, 1652 bp, Homo sapiens
agctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttac

SEQ ID NO: 13256 - DNA, 3612 bp, Homo sapiens
gaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttct

SEQ ID NO: 13257 - DNA, 2737 bp, Homo sapiens
gttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgatgcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatgattcctgtggaattgtgaattcatactaa

SEQ ID NO: 13258 - DNA, 2346 bp, Homo sapiens
agaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagt

SEQ ID NO: 13259 - DNA, 2177 bp, Homo sapiens
aacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccgaggaacggccagaccccgcgggccggagcagaacgcggccagggcagaaagcggcggcaggagaagcaggcagggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaagcaaatgaaaaaaaagttgaccagcctccagaagctaaaaagcccaaaataaaggtggtgaatgttgagctg

SEQ ID NO: 13260 - DNA, 3274 bp, Homo sapiens
acacttctcccagcgggactacgattcccaacatgctctccggacagctggccggcctccccaccatcccggtgtctggggtctctgcaaaaatggggtctgtctccgcccgcccagcctccctttagcgttaaggatcggacaccacctcccggtagtaaattgtgactattccgagttttggagtcattcttcgttgcctgttttattagggcagcaaaacgcctgtggctagggcgggagtgggcggaggcaggtttgagccaatggcacgggagcggccctgtcgctgccatggcaacggcggccgttctccggggaccggctgcccattgggtagaatctttccagaaggctcgagaagaaggaagcggaagtggcacgtggaggggccggtggaggcgccggtcagtcatatcatttggatcaaaaaatagaacaatcggagttgcagccaaaaatcagcaaatcactcatgcaaacaatacggtgtctaacttcaaaagatttcatggccgagcattcaatgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtg

SEQ ID NO: 13261 - DNA, 950 bp, Homo sapiens
cctacccgcgcagggtgtgctagcgcgctcagccctctccggccggcttagtctagttcccgggcctcgctcggttccagaactttccagaaaatgccgcgctccctacggctcaagggtcaaatcgcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgagtggttaa

SEQ ID NO: 13262 - DNA, 570 bp, Homo sapiens
gcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgac

SEQ ID NO: 13263 - DNA, 478 bp, Homo sapiens
cgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatgggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctg

SEQ ID NO: 13264 - DNA, 2150 bp, Homo sapiens
attaatagccaggccttagtgccccgctcggggagggcggctccagctcctggagcaagaggagggcggagctgagcggagtggccaggggaggagagagtgtccggagaggccggctgaacttggacgcggcccctcccagctccccccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttctta

SEQ ID NO: 13265 - DNA, 763 bp, Homo sapiens
gcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggtgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagtt

SEQ ID NO: 13266 - DNA, 2892 bp, Homo sapiens
cttttacctctgactgaaatcccacctaaggcgctcgcaggcatcacctctgacacagagatggagcagacagttgccgggaacacaaccttctagacctttaaggagaaagctgccaactttgtcctcttggggctgctgaatgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacgggggaaacaaaacacacaataaaccccaaacttgcaaggttctggggcaggcaccgaggtccgagtggcaaggagacaggatccagccctgtgcagtggtgaggaggcccctggggctgctgtgatcagcctggaatgtcaggctgtgagctcagccctctcggcctgcgtgtcgggctgtcagcagggccggcgcacgggagaagatttccagccccctctgggccatggagaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagac

SEQ ID NO: 13267 - DNA, 2905 bp, Homo sapiens
cttttacctctgactgaaatcccacctaaggcgctcgcaggcatcacctctgacacagagatggagcagacagttgccgggaacacaaccttctagacctttaaggagaaagctgccaactttgtcctcttggggctgctgaatgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacgggggaaacaaaacacacaataaaccccaaacttgcaaggttctggggcaggcaccgaggtccgagtggcaaggagacaggatccagccctgtgcagtggtgaggaggcccctggggctgctgtgatcagcctggaatgtcaggctgtgagctcagccctctcggcctgcgtgtcgggctgtcagcagggccggcgcacgggagaagatttccagccccctctgggccatggagaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacag

SEQ ID NO: 13268 - DNA, 844 bp, Homo sapiens
cttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgccca

SEQ ID NO: 13269 - DNA, 485 bp, Homo sapiens
acgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccaggcaagtgatccgggccctgaggggaggggaggtgcacagggaggggacgtctgctccagggcgccaccgaaggcgctgtggctgccggtcggcctggaacaggtgctgcacagcctgcagccatgtgtggccaccaagacagatgtggccacagggacagatgtggccatgaaaacaggtgggctgtaggaatgaggaggagctta

SEQ ID NO: 13270 - DNA, 2299 bp, Homo sapiens
gccccgacgcgcaccgcgattcgccccaagggccctgcgcaggacgctgacgcgaagactcggaggcggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagtt

SEQ ID NO: 13271 - DNA, 2455 bp, Homo sapiens
agactaagccggccggagagggctgagcgcgctagcacaccctgcgcgggtagggaggggcggggctcgcgcgcagggtgtgcagattgcagggcccgggctgacgggaagtgggtgggagctgcctgcacacgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaataa

SEQ ID NO: 13272 - DNA, 533 bp, Homo sapiens
ccctcactcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtgggtctgcccacaaggccgttttcgcgaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagg

SEQ ID NO: 13273 - DNA, 549 bp, Homo sapiens
attgcggtgtgcgccctgcactctgtccctcactcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattgga

SEQ ID NO: 13274 - DNA, 754 bp, Homo sapiens
cggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagatggaaaaacactgaatgatgaattagaaattattgaaggcatgaagtttgatcgaggctatatttctccatactttattaatacatcaaaaggtaagaaca

SEQ ID NO: 13275 - DNA, 578 bp, Homo sapiens
actcgccgccgacgacctgtctcgccgagcgcacgccttgccgccgccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaa

SEQ ID NO: 13276 - DNA, 888 bp, Homo sapiens
gaagactcggaggcggaagaaaaaaggagctgtttctaggcttttctaggcgcccagccgaggtgaaagaactaccccttcgtcccctcccggaaatgacgcgatttgacccttgagccgtagggagcgcggcattttctggaaagttctggaaccgagcgaggcccgggaactagactaagccggccggagagggctgagcgcgctagcacaccctgcgcggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcga

SEQ ID NO: 13277 - DNA, 1306 bp, Homo sapiens
actcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgca

SEQ ID NO: 13278 - DNA, 748 bp, Homo sapiens
attttctggaaagttctggaaccgagcgaggcccgggaactagactaagccggccggagagggctgagcgcgctagcacaccctgcgcggaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtaggaatgtctgttgtcaccacagtgttctaaacttcagtgtgctttaaggcattgattccttggacctaaggaaagtgttaacttgaggaaattaatccttctctcattcctcctcttggcctggagaaatcttaaactgggttttcctttagcaagcttggctgtatggtgggtaggtactgttaggtaattttgatattttacttagttggtttcttttgttttt

SEQ ID NO: 13279 - DNA, 3151 bp, Homo sapiens
gaggaggcgggaggcctcagggccgggcgcacgtcgagggctgcggccgccgcagcgggcacggccaacgagctgcgggcccgggatcgcggcggctggacggggctggagctgtcgggagggcggagctacagggcctgcaaggatgttggctgtcccggagatgggcctgcaggggctgtacatcggctccagcccggagcggtccccagtgcctagcccacccggctccccgaggacccaggaaagctgcggcattgcccccctcacaccctcgcagtctccaaaacccgaggtccgagccccccagcaggcctccttctctgtggtggtggccattgacttcggcaccacgtctagtggctatgctttcagctttgccagtgaccctgaggccatccacatgatgaggaaatgggagggcggagacccgggcgtggcccaccagaagaccccgacctgcctgctgctgactccggagggcgccttccacagctttggctacaccgcccgcgattactaccatgacctggaccccgaagaggcgcgggactggctctacttcgagaagttcaagatgaagatccacagcgccacggatctcaccttgaagacccagctagaggcagtaaatggaaagacgatgcccgccctggaggtgttcgcccatgccctgcgcttcttcagggagcacgcccttcaggagctgagggagcagagcccatcgctgccagagaaggacactgtgcgctgggtgttgacggtgcctgccatctggaaacagccagccaagcagttcatgcgggaggctgcctacctggctggactagtgtcccgagagaatgcagagcagctactcatcgccctggagcccgaggccgcctcggtatactgccgcaagctgcgcctgcaccagctcctggacctgagtggccgggccccaggtggtgggcgcctgggtgagcgccgctccatcgactccagcttccgtcaggctcgggagcagctgcgaaggtcccgccacagccgcacgttcctggtggagtcaggcgtaggagagctgtgggcagagatgcaagcaggagaccgctacgtggtggccgactgcggcggaggcaccgtggacctgacggtgcaccagctggagcagccccatggcaccctcaaggagctctacaaggcatctgggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaaggggaa

SEQ ID NO: 13280 - DNA, 3009 bp, Homo sapiens
ggccgccgcagcgggcacggccaacgagctgcgggcccgggatcgcggcggctggacggggctggagctgtcgggagggcggagctacagggcctgcaaggatgttggctgtcccggagatgggcctgcaggggctgtacatcgaaacccgaggtccgagccccccagcaggcctccttctctgtggtggtggccattgacttcggcaccacgtctagtggctatgctttcagctttgccagtgaccctgaggccatccacatgatgaggaaatgggagggcggagacccgggcgtggcccaccagaagaccccgacctgcctgctgctgactccggagggcgccttccacagctttggctacaccgcccgcgattactaccatgacctggaccccgaagaggcgcgggactggctctacttcgagaagttcaagatgaagatccacagcgccacggatctcaccttgaagacccagctagaggcagtaaatggaaagacgatgcccgccctggaggtgttcgcccatgccctgcgcttcttcagggagcacgcccttcaggagctgagggagcagagcccatcgctgccagagaaggacactgtgcgctgggtgttgacggtgcctgccatctggaaacagccagccaagcagttcatgcgggaggctgcctacctggctggactagtgtcccgagagaatgcagagcagctactcatcgccctggagcccgaggccgcctcggtatactgccgcaagctgcgcctgcaccagctcctggacctgagtggccgggccccaggtggtgggcgcctgggtgagcgccgctccatcgactccagcttccgtcaggctcgggagcagctgcgaaggtcccgccacagccgcacgttcctggtggagtcaggcgtaggagagctgtgggcagagatgcaagcaggagaccgctacgtggtggccgactgcggcggaggcaccgtggacctgacggtgcaccagctggagcagccccatggcaccctcaaggagctctacaaggcatctgggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaaggggaa

SEQ ID NO: 13281 - DNA, 2126 bp, Homo sapiens
ggaggcctcagggccgggcgcacgtcgagggctgcggccgccgcagcgggcacggccaacgagctgcgggcccgggatcgcggcggctggacggggctggagctgtcgggagggcggagctacagggcctgcaaggatgttggctgtcccggagatgggcctgcaggggctgtacatcggaaatgggagggcggagacccgggcgtggcccaccagaagaccccgacctgcctgctgctgactccggagggcgccttccacagctttggctacaccgcccgcgattactaccatgacctggaccccgaagaggcgcgggactggctctacttcgagaagttcaagatgaagatccacagcgccacgagccgccctgtgtccctgccaggatctcaccttgaagacccagctagaggcagtaaatggaaagacgatgcccgccctggaggtgttcgcccatgccctgcgcttcttcagggagcacgcccttcaggagctgagggagcagagcccatcgctgccagagaaggacactgtgcgctgggtgttgacggtgcctgccatctggaaacagccagccaagcagttcatgcgggaggctgcctacctggctggactagtgtcccgagagaatgcagagcagctactcatcgccctggagcccgaggccgcctcggtatactgccgcaagctgcgcctgcaccagctcctggacctgagtggccgggccccaggtggtgggcgcctgggtgagcgccgctccatcgactccagcttccgtcaggctcgggagcagctgcgaaggtcccgccacagccgcacgttcctggtggagtcaggcgtaggagagctgtgggcagagatgcaagcaggagaccgctacgtggtggccgactgcggcggaggcaccgtggacctgacggtgcaccagctggagcagccccatggcaccctcaaggagctctacaaggcatctgggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagcccc

SEQ ID NO: 13282 - DNA, 5722 bp, Homo sapiens
ggcggctcagacacggcccgagcgccgccgcggacgcggacagagacccgcacgggcacgggcgctgcgctggaggctcccctcgcggtccggggctgcgcgaccatggcggacaaggaggccggcggcagcgacgggccccgagaaacggctcccacatctgcatattcatctccagcccggagtcttggggacacaggaataacgcctctgtccccctcccatattgtgaacgacactgactccaacgtctcagaacagcagtcatttctcgtggtggtggccgtcgactttgggaccacatccagtggctatgcctacagcttcaccaaggagccggaatgcatccatgtgatgaggcgatgggagggaggtgaccctggtgtgtccaatcagaagactccaaccaccatcttgctgactcccgagaggaagttccacagcttcgggtatgccgccagggacttttaccatgacctggatcccaatgaggccaagcagtggctgtacctggagaagttcaagatgaagctgcacaccactggggacctcaccatggatacagacctgacggcagcaaatggcaagaaagtcaaagcccttgaaatctttgcttatgccctgcagtactttaaggagcaggcgctgaaggagctgagtgaccaggcgggttcggagttcgagaactctgatgtcagatgggtcatcacggtgcctgccatctggaagcagccggccaagcagttcatgagacaagctgcctaccaggcaggcctggcctcccccgagaactcggagcagctcatcattgccttggagcctgaggcagcctctatctactgccgaaagctgcggctacaccagatgattgagctgagcagcaaggcagccgtcaatgggtacagcggcagtgacacagtaggagctgggtttacacaggctaaggaacacatacggcgtaatcggcagagtcggacctttttggtggagaatgtcataggagaaatctggtccgagctggaggaaggtgataagtatgtggttgtggacagtggcggtggcaccgtagacctgacagtccatcagatccggttaccggagggacaccttaaggaactgtataaagcaacaggcggaccctatggatctttaggagtagattatgagttcgaaaaacttctgtataaaatatttggagaggattttattgaacaattcaaaatcaaacgccctgcagcctgggttgacttaatgattgcgtttgagtctcgcaaaagggcggctgccccagacagaactaacccgctgaacatcaccctgcccttctccttcattgactactacaagaagttccgcgggcacagtgtggagcacgccttgcggaaaagcaatgtggattttgtgaagtggtcctcgcaggggatgctgcggatgagtccagatgccatgaacgccctttttaagccgaccatcgatagcatcattgagcatctccgggacctgtttcagaagcccgaggtgtccaccgtcaagttcctctttctggtgggcggctttgccgaggcgcccctgctgcagcaggcggtgcaggctgcttttggggaccagtgccggatcatcatcccccaggacgtgggcctcaccatcctcaagggtgccgtcctctttggcctggaccccgcggtcatcaaggtgcgccggtcgccgctcacctacggggtaggcgtgctgaaccgctacgtggagggcaagcacccgcctgagaagctgctggtgaaggatggcactcggtggtgcaccgacgtctttgacaagttcatctctgccgaccagtctgtggctctgggtgagctggtcaagcgtagctacaccccggccaagccctcccagctggtcattgtcatcaacatctacagctctgagcacgacaacgtcagcttcatcactgatcccggggtgaagaagtgtggcacgctccgcctggatctcacagggaccagtggcactgcggtgcccgcccggagggagatccagacccttatgcagttcggggacaccgagatcaaagccacagccattgatatagccacttcgaagagtgtcaaagttgggatcgacttcttaaattactaaccctcccgccccgctgcctgtccccttggactcaacttatctgcatctgctgacctcaaccttgactgttctttccctaaccttgaccctcaccattgcccatgtgaatttcagcagggaagatgagaacaatcagggctagaaataattagtgacttttgagggcacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatacttgatgtattaagtcagttttttttcacagcgggcctgtggctcgcctgcatcagaattgcctgggtgcgtgttcagaacaggttcctggatctgagccctttttaactgaggccgactcttggagaggggcaccagaatctgcatttgtagtgtataccacatcgtggttcaactgaaattggagaaatactaacctgagattttgttgaagttcacacacagatcacagcccgccctctgcaggtgtcccctttgggctcctttaggaagagggcttccatgagaaggtgaccccataccttgccctcttggtcaatgggattggggctccacctggcttggagatggcccttttaaccctcacaggaagggccaggggaggaaaaaaattgcaagaaagcgacaccaagaacggagctgactgaggaaccaactggagggtcttcactctctccttccccagtgtacaaaaccagttttctgcaacattcaggagccaaatgaggaaaaagaatcaagaatctgactcacagcccatctgatctgttcaaagctgtcttttccacctgctgaaattcattaaatcactggaggcatgcataatgaatggagaatgagtgaacttccaatgcaacttggattcacaaacccattatcatagccaatatgcagattttaaacagcatttcacatttcatttgaccatgtcttctttttcgcatcgcctgctgcagaattccctactagaatgtgaaacaacgaacaaaccacagaacttagagtgtgctggttagtcacataacttagtagcaggattgtgtatccaggcacaaaggtgtctttgctaatgttctcttgctacctgccctgcttcaaacgctaaatggtatgggtctttctttgttgccagccatattctacaaataagacttttcaatatagttatgagtaatataattttatgtacatataatgttagaatattgtacagaatcttggtttctacgatgcgcttttcttgtttcaaaaagaggaaaatgcttgatttttgttgatgatacttttgttactgtccttaattttccatagtttggtttcttaattgtgctcactaagcatcgatctgtgctgatgccaagctatggactatgtacgcaagaccgagcaatagacagaggtgcctagggtccaaacacactgaacgcacgtggaccgcctggatcaggagcctcatcagacccttctccatgcacatccttcccaaacagtcacagattccattgaaaggagcagattctatcagttcttctgtgcagactttaagagctgaacgttctggttctggaagccatgtgactgcgcagaacaacctaagaaaccctttgtgtcctgaggggtcgttgacctctccttccgggtcggagcagtcactctgagggcaaagcgtggtccactgtgtgtgatgttttcaggatgctagggtcaaagaaagaaaccaagtggtacataagcccagcttttctgctgggctaagtgtaagtgtgagtaacatggtcaagcccctcttttttgggctaatgtaaagcctttcctgccttgcattaatgctatctccctgtgtactgtttctcttaaatgagcagatagaaatctgcagtgttggcagataggtgatggagaggatgataattttatcttctggccacagagctgcagccccagttgtcagagtccttaaatgaaacccccaaatccatccctccttccctacccccactggaatattctagaataagagcactggataagtacacttgaacacatttttctaaccttagaaaatacctacaaggcctgttgtcttgacccattactcaattgtccctggcatattatctgatcttcacgtttcttggaagcagaatcatcaaggctttcctttgtaactgccctttccgtacacagcaggcatgaataaatgctgagtaacagacaagttacagacaggaggggaaagaggaggaaccatacaactgtttttgcaaaatgatggctgagtccagattatagaggttgccttacccttagaatgttatttagaccaagtttagcttttagagtccaggtctggttaattgccagggtagcaaagaatcgcatgcaccaatgtaaacaggagtcagaatgcattattagtcaaagatcgaatttcacattgtagagatgtatagctgtgattaagctgcatatgtatgctgggaaacggcttgagtggatggctaatataaaagttgttggccataatgccacacctctcatctgcttgaaatatggaccagtattctaaaatatcagctactggggtctcattcactacaagataaattcaaacttcacagaactttgcagcagttcaccaccagacgggactgtgtctgcaaactctcttgtcttcacagacgcctaataaagcaaaactctgaatctca

SEQ ID NO: 13283 - DNA, 1978 bp, Homo sapiens
gtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagccagaaatgcggtccttggacctggcttctcagcttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgc

SEQ ID NO: 13284 - DNA, 1904 bp, Homo sapiens
gcactgtgcagtttccgcggagcgcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaa

SEQ ID NO: 13285 - DNA, 1689 bp, Homo sapiens
gaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattc

SEQ ID NO: 13286 - DNA, 578 bp, Homo sapiens
cagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaaggagcttattctccatggagtcagtctaattcagaagatggttgatactgaagcctaagagccaggctgtttggaaagctaattctgtgtccaaatatatcaccaaaaccacaagaagtgctgcatgatttcagagcgcagagaagaaaattgacacgggggcggggtgggcaagcaagtgtattgggaaatatgttaagtgagatctttgtcataaattaataaacctcagaaagt

SEQ ID NO: 13287 - DNA, 2427 bp, Homo sapiens
ataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattc

SEQ ID NO: 13288 - DNA, 1909 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13289 - DNA, 1909 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13290 - DNA, 2483 bp, Homo sapiens
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13291 - DNA, 1909 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13292 - DNA, 2483 bp, Homo sapiens
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13293 - DNA, 2483 bp, Homo sapiens
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13294 - DNA, 1452 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaag

SEQ ID NO: 13295 - DNA, 2483 bp, Homo sapiens
gagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 13296 - DNA, 1909 bp, Homo sapiens; identical to SEQ ID NO: 13289

SEQ ID NO: 13297 - DNA, 1909 bp, Homo sapiens; identical to SEQ ID NO: 13288

SEQ ID NO: 13298 - DNA, 1867 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtgcagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattag

SEQ ID NO: 13299 - DNA, 2344 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattc

SEQ ID NO: 13300 - DNA, 1867 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtgcagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattag

SEQ ID NO: 13301 - DNA, 1867 bp, Homo sapiens; identical to SEQ ID NO: 13300

SEQ ID NO: 13302 - DNA, 1867 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtgcagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattag

SEQ ID NO: 13303 - DNA, 1452 bp, Homo sapiens
aacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaag

SEQ ID NO: 13304 - DNA, 1867 bp, Homo sapiens; identical to SEQ ID NO: 13298

SEQ ID NO: 13305 - DNA, 1452 bp, Homo sapiens; identical to SEQ ID NO: 13294

SEQ ID NO: 13306 - DNA, 1452 bp, Homo sapiens; identical to SEQ ID NO: 13294

SEQ ID NO: 13307 - DNA, 1452 bp, Homo sapiens; identical to SEQ ID NO: 13303

SEQ ID NO: 13308 - DNA, 2520 bp, Homo sapiens
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaacttt

SEQ ID NO: 13309 - DNA, 2524 bp, Homo sapiens
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaactttt

SEQ ID NO: 13310 - DNA, 2525 bp, Homo sapiens
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttttttttttttttttttttttttttttttgcttggcgaaaacactacaaaggctgggaatgtatgtttttataatttgtttatttaaatatgaaaaataaaatgttaaactttt

SEQ ID NO: 13311 - DNA, 1054 bp, Homo sapiens
atggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgacctt

SEQ ID NO: 13312 - DNA, 2521 bp, Homo sapiens
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttt

SEQ ID NO: 13313 - DNA, 2515 bp, Homo sapiens
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgttttttttttttttttttttttgcttggcgaaaacactacaaaggctgggaatgtatgtttttataatttgtttatttaaatatgaaaaataaaatgttaaactttt

SEQ ID NO: 13314 - DNA, 2519 bp, Homo sapiens
ggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagacagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaacttt

SEQ ID NO: 13315 - DNA, 1653 bp, Homo sapiens
atggccaaagccgcggcgatcggcatcgacctgggcaccacctactcctgcgtgggggtgttccaacacggcaaggtgcagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattag

SEQ ID NO: 13316 - DNA, 1875 bp, Homo sapiens
atggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattag

SEQ ID NO: 13317 - DNA, 2166 bp, Homo sapiens
aaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctct

SEQ ID NO: 13318 - DNA, 2166 bp, Homo sapiens
aaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctct

SEQ ID NO: 13319 - DNA, 1653 bp, Homo sapiens
atggccaaagccgcggcgatcggcatcgacctgggcaccacctactcctgcgtgggggtgttccaacacggcaaggtgcagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctggcggcttcggggctcagggtcccaagggagggtctgggtcaggccctaccattgaggaggtggattag

SEQ ID NO: 13320 - DNA, 2166 bp, Homo sapiens
aaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctct

SEQ ID NO: 13321 - DNA, 1653 bp, Homo sapiens; identical to SEQ ID NO: 13315

SEQ ID NO: 13322 - DNA, 2102 bp, Homo sapiens
ggcttttaattgtgggggcttgctgggcctgcgcagttgtgggcagggggctggtgcggggagcgggttacgcgcgtccaggggagggtgggggcgtttgtgttgacaccgcccggccacgttacaatggagatactgtctctgacctcatgggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccacggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaa

SEQ ID NO: 13323 - DNA, 2544 bp, Homo sapiens
gggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccacggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 13324 - DNA, 2544 bp, Homo sapiens
gggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 13325 - DNA, 2019 bp, Homo sapiens
aaactcgacgcgccggtgcctgcagccgcacaggttcgctctgggaagccttgggacaacgggagtcactctcgaaaaaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccacggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaa

SEQ ID NO: 13326 - DNA, 2544 bp, Homo sapiens; identical to SEQ ID NO: 13323

SEQ ID NO: 13327 - DNA, 696 bp, Homo sapiens
gccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaaggggctccacccgcatccccaaggtgcagcggctgcttcaggactacttcaatggacgtgatc

SEQ ID NO: 13328 - DNA, 2544 bp, Homo sapiens; identical to SEQ ID NO: 13324

SEQ ID NO: 13329 - DNA, 1984 bp, Homo sapiens
aaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaa

SEQ ID NO: 13330 - DNA, 696 bp, Homo sapiens; identical to SEQ ID NO: 13327

SEQ ID NO: 13331 - DNA, 2019 bp, Homo sapiens; identical to SEQ ID NO: 13325

SEQ ID NO: 13332 - DNA, 1984 bp, Homo sapiens; identical to SEQ ID NO: 13329

SEQ ID NO: 13333 - DNA, 1984 bp, Homo sapiens
aaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccacggacaagagcaccggcaaggtgaacaagatcaccatcaccaatgacaagggccgcctgagcaaggaggagattgagcgcatggttctggatgctgagaaatataaagctgaagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaa

SEQ ID NO: 13334 - DNA, 2019 bp, Homo sapiens
aaactcgacgcgccggtgcctgcagccgcacaggttcgctctgggaagccttgggacaacgggagtcactctcgaaaaaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaa

SEQ ID NO: 13335 - DNA, 696 bp, Homo sapiens; identical to SEQ ID NO: 13327

SEQ ID NO: 13336 - DNA, 696 bp, Homo sapiens; identical to SEQ ID NO: 13327

SEQ ID NO: 13337 - DNA, 2019 bp, Homo sapiens; identical to SEQ ID NO: 13334

SEQ ID NO: 13338 - DNA, 2767 bp, Homo sapiens
ccagcagcaggaggcgcgcgaggcaccacggcctggcggccgagagtcagggaggaacctcatttacataacggccgcccctctgtctcctggcgggggccggagtcccgcccctcgtccaacttgaaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctc

SEQ ID NO: 13339 - DNA, 2464 bp, Homo sapiens
ctctcttgcctgccgccatgtgcctttcgccttctgccgtgattgtgaggcctccccagccatatggaagttcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggctgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctcaaa

SEQ ID NO: 13340 - DNA, 1816 bp, Homo sapiens
gagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaatgcaaatgtaaagtaaagctgaaattgatctc

SEQ ID NO: 13341 - DNA, 4825 bp, Homo sapiens
ctttcgtagctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctcaggatttgccctatccagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggaccaggaggaaccacatgttgaagagcaacagcagcagacaccagcagaaaataaggcagagtctgaagaaatggagacctctcaagctggatccaaggataaaaagatggaccaaccaccccaagccaagaaggcaaaagtgaagaccagtactgtggacctgccaatcgagaatcagctattatggcagatagacagagagatgctcaacttgtacattgaaaatgagggtaagatgatcatgcaggataaactggagaaggagcggaatgatgctaagaacgcagtggaggaatatgtgtatgaaatgagagacaagcttagtggtgaatatgagaagtttgtgagtgaagatgatcgtaacagttttactttgaaactggaagatactgaaaattggttgtatgaggatggagaagaccagccaaagcaagtttatgttgataagttggctgaattaaaaaatctaggtcaacctattaagatacgtttccaggaatctgaagaacgaccaaaattatttgaagaactagggaaacagatccaacagtatatgaaaataatcagctctttcaaaaacaaggaggaccagtatgatcatttggatgctgctgacatgacaaaggtagaaaaaagcacaaatgaagcaatggagtggatgaataacaagctaaatctgcagaacaagcagagtttgaccatggatccagttgtcaagtcaaaagagattgaagctaaaattaaggagctgacaagtacttgtagccctataatttcaaagcccaaacccaaagtggaacctccaaaagaggaacaaaaaaatgcagagcagaatggaccagtggatggacaaggagacaacccaggcccccaggctgctgagcagggtacagacacagctgtgccttcggattcagacaagaagcttcctgaaatggacattgattgattccaacacttgtttctattaaaacagactattataaagctttaagttgtcaactttgttctaaatatcaactagcgcaagtgaatactgaagatttcttagtcagtttttaggggattttcggggaggggaaataggtaatgtatggagcattttcacttctaaatagttagatacagaaattaagtgcattgtatctttttcataatggtactatttagaagcccagttagtcttactgagcttatgcttcactcctttatgtttaaccatgtgtctacaagaataagtttgttttggaaagttgagctatagctacagctctagctatccagcagacttttcattatgacttacatggcaggagctctaattatgctttaaaaatctgttgtggagattgctttaaatgctccctgcctggtgtggggatggggtccccctctttgtgagggctggagcatggcacggcatggattaacacggcagaggaacaaaggtgtgctctgagcttcttcatatttcaccttcaccctcacctgtgttctcttccctctctcccaataaaagggctcccattataaatgccatgtacttctcttgggaaaatagacccccttgcctagagtaagttgttaactgagggctttaaacctggaggctcttcctgaaagtatgttcatgaataccccaagcatcaaggtctaaataattttcagaagattagaattgggtagatatactgttggatatagccatggtaaatttaactgaggaattaaatccttgttaattttggtgtaaagatttgtatcctggcctgtttattcaggtgggagatgttctgtataattttgaggtatagcttgaactcctagaacaagagttaaaagttctttttagctcattcacaatcacttgtgtgttaagtgttaatatctgtcatgaacctgccaatttgtacgtgttaagcagctgacagatgatgcaaaaaaaactaagatacactggattgtactggatgagtctgaaattagtgttaaagaagtgtggtgcctgatgttataacaacacctcattcttaactgtgtggccaatgtcaggtataccaaagcattcctctgactgctttttggggcagtgttgacaggagtgaggcattttggaaactccaagggaagcctgtgtttgaggccagagttggtacctgctttaagaaactgttacagggcttgttggtaatgttttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggaggaaggggaaagtatacttatgttggtgtgtaagcatgcatggaggcctcgaggcaccacaacaaggccaggttcttagcacatcctctgttctctacctgtcatgcttcaagagttccagctggcctgctgtgaagccagtagctattttaaaagtgctggctgcaggattaagccaaccctttacaactggcccagaccgtaatggccatttcttcttaaaaaaaaaaaaattttttttttttttttttttttttttttttttttttttggtgtgtgtgtgtgtgtgtgtggggaagggtgtgggtgctgggatgggggtgaatttcaagttgaaacacgatgatgtggtctgcttgctctctgcttagacaggctttaagaccaattggattttcatggaggccaggacagagagtggtaattgatggcttgtgtacagacaagcatttatccaggttgcgttatccaaactgatttgttaaagctccaggtcacgttcttacactaagaaaatcattcagtaaacatgagacaagtttaggaaaaactaataaaataaacctgtcttaaacttgaa

SEQ ID NO: 13342 - DNA, 728 bp, Homo sapiens
gctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcagaatggaccagtggatggacaaggagacaacccaggcccccaggctgctgagcagggtacagacacagctgtgccttcggattcagacaagaagcttcctgaaatggacattgattga

SEQ ID NO: 13343 - DNA, 1703 bp, Homo sapiens
gctctggtgctgcggctccgctctcgtcgcaacgagatctttcgagatcttctccgcccccgctaccggcgcctcctctgcggccactgagccggagccggcctgagcagcgctctcggttgcagtacccactggaaggacttaggcgctcgcgtggacaccgcaagcccctcagtagcctcggcccaagaggcctgctttccactcgctagccccgccgggggtccgtgtcctgtctcggtggccggacccgggcccgagcccgagcagtagccggcgccatgtcggtggtgggcatagacctgggcttccagagctgctacgtcgctgtggcccgcgccggcggcatcgagactatcgctaatgagtatagcgaccgctgcacgccggcttgcatttcttttggtcctaagaatcgttcaattggagcagcagctaaaagccaggtaatttctaatgcaaagaacacagtccaaggatttaaaagattccatggccgagcattctctgatccatttgtggaggcagaaaaatctaaccttgcatatgatattgtgcagttgcctacaggattaacaggtataaaggtgacatatatggaggaagagcgaaattttaccactgagcaagtgactgccatgcttttgtccaaactgaaggagacagccgaaagtgttcttaagaagcctgtagttgactgtgttgtttcggttccttgtttctatactgatgcagaaagacgatcagtgatggatgcaacacagattgctggtcttaattgcttgcgattaatgaatgaaaccactgcagttgctcttgcatatggaatctataagcaggatcttcctgccttagaagagaaaccaagaaatgtagtttttgtagacatgggccactctgcttatcaagtttctgtatgtgcatttaatagaggaaaactgaaagttctggccactgcatttgacacgacattgggaggtagaaaatttgatgaagtgttagtaaatcacttctgtgaagaatttgggaagaaatacaagctagacattaagtccaaaatccgtgcattattacgactctctcaggagtgtgagaaactcaagaaattgatgagtgcaaatgcttcagatctccctttgagcattgaatgttttatgaatgatgttgatgtatctggaactatgaatagaggcaaatttctggagatgtgcaatgatctcttagctagagtggagccaccacttcgtagtgttttggaacaaaccaagttaaagaaagaagatatttatgcagtggagatagttggtggtgctacacgaatccctgcggtaaaagagaagatcagcaaatttttcggtaaagaacttagtacaacattaaatgctgatgaagctgtcactcgaggctgtgcattgcagtgtgccatcttatcgcctgctttcaaagtcagagaattttctatcactgatgtagtaccatatccaatatctctgagatggaattctccagctgaagaagggtcaagtgactgtgaagtcttttccaaaaatcatgctgctcctttctctaaagttcttacattttatagaaaggaacctttcactcttgaggcctactacagctctcctggatttgccctatccagatcctgctatagcatcataaagtcactcctcagtctgatggctccagttcaaaagtga

SEQ ID NO: 13344 - DNA, 3908 bp, Homo sapiens
acagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaa

SEQ ID NO: 13345 - DNA, 1141 bp, Homo sapiens
gacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacttttctgagaccctgactcgggccaaatttgaagagctcaacatggatctgttccggtctactatgaagcccgtccagaaagtgttggaagattctgatttga

SEQ ID NO: 13346 - DNA, 2646 bp, Homo sapiens
agagccagcccggaggagctagaaccttccccgcatttctttcagcagcctgagtcagaggcgggctggcctggcgtagccgcccagcctcgcggctcatgccccgatctgcccgaaccttctcccggggtcagcgccgcgccgcgccacccggctgagtcagcccgggcgggcgagaggctctcaactgggcgggaaggtgcgggaaggtgcggaaaggttcgcgaaagttcgcggcggcgggggtcgggtgaggcgcaaaaggataaaaagccggtggaagcggagctgagcagatccgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccacacgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacttttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttgcggggagggcggttcatcctcttctgcttcaaataaaaagtcattaatttattaaaacttgtgtggcactttaacattgctttcacctatattttgtgtactttgttacttgcatgtatgaattttgttatgtaaaatatagttatagacct

SEQ ID NO: 13347 - DNA, 2176 bp, Homo sapiens
cgagccgggctggctgcagagaaaccgcagggagagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccctgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccacacgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacttttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttgcggggagggcggttcatcctcttctgcttcaaataaaaagtcattaatttatt

SEQ ID NO: 13348 - DNA, 2186 bp, Homo sapiens
cagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggca

SEQ ID NO: 13349 - DNA, 2004 bp, Homo sapiens
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 13350 - DNA, 1924 bp, Homo sapiens
agcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccaca

SEQ ID NO: 13351 - DNA, 2306 bp, Homo sapiens
ggtttgcctggcgcgcggggaagtggagccagcgttttctttcacccagttccctgcttagtccagtcccaccgtggttcttcagagctgttcttggcgtgcttccagtatggggcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 13352 - DNA, 1826 bp, Homo sapiens
ctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 13353 - DNA, 1884 bp, Homo sapiens
tacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggc

SEQ ID NO: 13354 - DNA, 2463 bp, Homo sapiens
atcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaa

SEQ ID NO: 13355 - DNA, 3321 bp, Homo sapiens
gtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 13356 - DNA, 2260 bp, Homo sapiens
ctctttgccgtcggagcgcttgtttgctgcctcgtactcctccatttatccgccatgataagtgccagccgagctgcagccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattct

SEQ ID NO: 13357 - DNA, 2733 bp, Homo sapiens
ggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttg

SEQ ID NO: 13358 - DNA, 2582 bp, Homo sapiens
ggcacgcagtagctctctcgagtcactccggcgcagtgttgggactgtctgggtatcggaaagcaagcctacgttgctcactattacgtataatccttttcttttcaagatttttattttagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 13359 - DNA, 2674 bp, Homo sapiens
gtgcccggatgctggggcgagggagggtgcactgcggcgccccctcctcgcgtggtcctggccgacgcatgtccggcagtgacgagtgtcggcctggtggctacggccaccatctttcttgggtttggtcctgttctgtaattttgtgctgtgaaagggtcgtggtggagcttttggcttaagaattctttgtccggatttaattgctcctccgatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 13360 - DNA, 1616 bp, Homo sapiens
ctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtgtgcccctgtcccacctggctccccctgctggtgtctagtgtttttttccctctcctgtccttgtgttga

SEQ ID NO: 13361 - DNA, 1640 bp, Homo sapiens
ctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgatgcccctgtcccacctggctccccctgctggtgtctagtgtttttttccctctcctgtccttgtgttga

SEQ ID NO: 13362 - DNA, 1703 bp, Homo sapiens
ctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataa

SEQ ID NO: 13363 - DNA, 2569 bp, Homo sapiens
ggcacgcagtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 13364 - DNA, 573 bp, Homo sapiens
attttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtgtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 13365 - DNA, 597 bp, Homo sapiens
attttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgatgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 13366 - DNA, 536 bp, Homo sapiens
attttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 13367 - DNA, 613 bp, Homo sapiens
ggcacgcagtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttat

SEQ ID NO: 13368 - DNA, 1634 bp, Homo sapiens
gaccaatgaaagagaggaaacagaagtacccggagggaggtgtttcaggattggctgggacgactgcctgcccgacagggcgtgtttgattggagaacctgccgagtgtagcagtaattggcaagaccgtgcaccaatgggaaggatctgaggctgggcttgcggttaggaggggcactgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgcc

SEQ ID NO: 13369 - DNA, 1457 bp, Homo sapiens
actgcaacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcgtcggcccaggccccaccgccagccgcagccaagtaggagggggctgggccgcgcccgcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctctgc

SEQ ID NO: 13370 - DNA, 1391 bp, Homo sapiens
aacgcggaggagcaggatggagatccctgtgcctgtgcagccgtcttggctgcgccgcgcctcggccccgttgcccggactttcggcgcccggacgcctctttgaccagcgcttcggcgaggggctgctggaggccgagctggctgcgctctgccccaccacgctcgccccctactacctgcgcgcacccagcgtggcgctgcccgtcgcccaggtgccgacggaccccggccacttttcggtgctgctagacgtgaagcacttctcgccggaggaaattgctgtcaaggtggtgggcgaacacgtggaggtgcacgcgcgccacgaggagcgcccggatgagcacggattcgtcgcgcgcgagttccaccgtcgctaccgcctgccgcctggcgtggatccggctgccgtgacgtccgcgctgtcccccgagggcgtcctgtccatccaggccgcaccagcaccccgggagcctcctcaggctccctctattaaagccgatctgactccgcccagccagatgtcccgagtgcgccaaggactgtcctctcacccactcctggattctgccctgacctccatcctggacactgccttgataacatagacccttccactgacaccctcgctctcacaccccctccagctttccgaccccacaccgacaactccccggcttccagaccctaccagcactaccctaaccctcagccgacagtctcagccccaccgacccactttcttggcatatagccccacttaagacccctcctctacttccttctgagtcctctacaaagacatccgggtactacatttccatcccttccctattttgacaccaaattatggtgtagacagccctcccccaaccccaggccagtcaggcacaatccccccaccccccaaacgtcctggactgcacagacctcccactccagaccatccaggcctggttcccaagacccgatccttcccctgcaaccagacagtctacaactgccccctccagcccattttctgccgtgaaaccccagccagccacaccagactctggaaccctttttcgactgccccaactcttggacaccaggccaactagaacacccaacaccaaactgtacagactctcccaccccaacctccccagactctgcacggatgtcctaggccccctccccaactctaaccagaccccatccccctaagtccctttgtcttgacccccaagtcttcaaccagatatcctcggcaacccacctcccaccctcctcctcttctccttcaagacccaactgagcacccgctctgattccccacagcctttctccctgccaccactcccttagtctttcccaggcttactctcccaataaatgtgctagagctct

SEQ ID NO: 13371 - DNA, 2142 bp, Homo sapiens
cgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgcta

SEQ ID NO: 13372 - DNA, 2549 bp, Homo sapiens
cggagacttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgatcttttcactagttctgtgcagatgaatcccacagattacatcaataatacaaaatctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtg

SEQ ID NO: 13373 - DNA, 2643 bp, Homo sapiens
acttgtccgtcacgtgcggccgcccggcctctcggccttgccgcgcgcctggcggggttgggggggcggggaccaagatctgctgcgcctgcgttgtgggcgttctcggggagctgctgccgtagctgccgccgccgctaccaccgcgttcgggtgtagaatttggaatccctgcgccgcgttaacaatgaagcagagttcgaacgtgccggctttcctcagcaagctgtggacgcttgtggaggaaacccacactaacgagttcatcacctggagccagaatggccaaagttttctggtcttggatgagcaacgatttgcaaaagaaattcttcccaaatatttcaagcacaataatatggcaagctttgtgaggcaactgaatatgtatggtttccgtaaagtagtacatatcgactctggaattgtaaagcaagaaagagatggtcctgtagaatttcagcatccttacttcaaacaaggacaggatgacttgttggagaacattaaaaggaaggtttcatcttcaaaaccagaagaaaataaaattcgtcaggaagatttaacaaaaattataagtagtgctcagaaggttcagataaaacaggaaactattgagtccaggctttctgaattaaaaagtgagaatgagtccctttggaaggaggtgtcagaattacgagcaaagcatgcacaacagcaacaagttattcgaaagattgtccagtttattgttacattggttcaaaataaccaacttgtgagtttaaaacgtaaaaggcctctacttctaaacactaatggagcccaaaagaagaacctgtttcagcacatagtcaaagaaccaactgataatcatcatcataaagttccacacagtaggactgaaggtttaaagccaagggagaggatttcagatgacatcattatttatgatgttactgatgataatgcagatgaagaaaatatcccagttattccagaaactaatgaggatgttatatctgatccctccaactgtagccagtaccctgatattgtcatcgttgaagatgacaatgaagatgagtatgcacctgtcattcagagtggagagcagaatgaaccagccagagaatccctaagttcaggcagtgatggcagcagccctctcatgtctagtgctgtccagctaaatggctcatccagtctgacctcagaagatccagtgaccatgatggattccattttgaatgataacatcaatcttttgggaaaggttgagctgttggattatcttgacagtattgactgcagtttagaggacttccaggccatgctatcaggaagacaatttagcatagacccagatctcctggttgattctgagaataaaggattagaaactaccaagaacaatgtagttcagccagtttcggaagagggaagaaaatctaaatccaaaccagataagcagcttatccagtataccgcctttccacttcttgcattcctcgatgggaaccctgcttcttctgttgaacaggcgagtacaacagcatcatcagaagttttgtcctctgtagataaacccatagaagttgatgagcttctggatagcagcctagacccagaaccaacccaaagtaagcttgttcgcctggagccattgactgaagctgaagctagtgaagctacactgttttatttatgtgaacttgctcctgcacctctggatagtgatatgccacttttagatagctaaatccccaggaagtggactttacatgtatatattcatcaaaatgatgaactatttattttaaagtatcatttggtactttttttgtaaattgctttgttttgtttaatcagatactgtggaataaaagcaccttttgcttttctcactaaccacacactcttgcagagctttcaggtgttactcagctgcatagttacgcagatgtaatgcacattattggcgtatctttaagttggattcaaatggccatttttctccaattttggtaaattggatatcttttttttacaaatacgaccattaacctcagttaaatttttgtttgttttcctgtttgatgctgtctatttgcattgagtgtaagtcatttgaactaatggtataactcctaaagctttctctgctccagttatttttattaaatatttttcacttggcttatttttaaaactgggaacataaagtgcctgtatcttgtaaaacttcatttgtttcttttggttcagagaagttcatttatgttcaaagacgtttattcatgttcaacaggaaagacaaagtgtacgtgaatgctcgctgtctgatagggttccagctccatatatatagaaagatcgggggtgggatgggatggagtgagccccatccagttagttggactagttttaaataaaggttttccggtttgtgtttttttgaaccatactgtttagtaaaataaatacaatgaatgttgagtactagtgtctgttatgtgtcttctttagaggtgacactcacatgaaacaattttttcttctcataggaagcagtagctttaaactgtctgtggttcattattctcaatatgaatcataccaagatatttgtgcctcatctcgaaaatatattgtatattg

SEQ ID NO: 13374 - DNA, 1899 bp, Homo sapiens
ggagtgagcgcggcagtggccctggcagctggcggagcggcccagcccgtgtgcacgtggcgccggcgctgcctttcggttgccaaaattcaggctgtagacggcgagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccggcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaaacctggaaaggaaagagcaagaattagagcagctgaaaatggattgtgagcactttaaagcccgcctggaaaccgtgcaggccgacaacataagagagaagaaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagataaagctttgaagtttttcagcatcactggtcaaacaatggagagttttgtgaagtcgttagacggtgatgtccaggagctggattcggatgaaagtcagtttgttttcgctctggctggaattgtcacgaatgttgctgctatagcatgtggtcgtgaattcttggttaattcaagccgggtgctcttggacaccatattgcagcttctgggagacttgaagccaggacagtgtaccaaactcaaagtgctaatgctgatgtccctatacaatgtaagcatcaatttgaaaggcttgaaatacatcagcgagagtccaggattcatccctttgctgtggtggcttttgagtgatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgta

SEQ ID NO: 13375 - DNA, 1454 bp, Homo sapiens
agagggcgcgccgacgctcaggcgaacggagcggaggcggcagcggccatgggcgaagcgggcgccgctgaggaggcctgccggacctggaaaggaaagagcaagaattagagcagctgaaaatggattgtgagcactttaaagcccgcctggaaaccgtgcaggccgacaacataagagagaagaaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagataaagctttgaagtttttcagcatcactggtcaaacaatggagagttttgtgaagtcgttagacggtgatgtccaggagctggattcggatgaaagtcagtttgttttcgctctggctggaattgtcacgaatgttgctgctatagcatgtggtcgtgaattcttggttaattcaagccgggtgctcttggacaccatattgcagcttctgggagacttgaagccaggacagtgtaccaaactcaaagtgctaatgctgatgtccctatacaatgtaagcatcaatttgaaaggcttgaaatacatcagcgagagtccaggattcatccctttgctgtggtggcttttgagtgatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcag

SEQ ID NO: 13376 - DNA, 2604 bp, Homo sapiens
agatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttc

SEQ ID NO: 13377 - DNA, 2514 bp, Homo sapiens
agatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgccttctacttacagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttc

SEQ ID NO: 13378 - DNA, 1249 bp, Homo sapiens
atgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccct

SEQ ID NO: 13379 - DNA, 1515 bp, Homo sapiens
atgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccg

SEQ ID NO: 13380 - DNA, 499 bp, Homo sapiens
aagggtgagtgtgaaataaacaaatcctgcagtgtttctgcgtcctattaaaggcggggtcggatctgaaagggaaggacagggaacgcgcggggtaccggaggagccatcccggcagaggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcagga

SEQ ID NO: 13381 - DNA, 1057 bp, Homo sapiens
agttcccagaatgccgcacgagcccgcccccagcgggagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttcc

SEQ ID NO: 13382 - DNA, 15337 bp, Homo sapiens
gcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggagagctccctcctagaaaagatgatagtgtcgaaccaagtggaacaaagaaagaagatctgaatgacaaagagaaaaaagatgaagaagaaactcctgcacctatatatagggccaagtcaattctggacagctgggtatggggcaagcaaccagatgtgaatgaactgaaggagtgtctttctgtgctggttaaagagcagcaggccctggccgtccagtcagccaccaccaccctctcagccctgcgactcaagcagaggctggtgatcttggagcgctatttcattgccttgaatagaaccgtttttcaggagaatgtcaaagttaagtggaaaagcagcggtatttctctgcctcctgtggacaaaaaaagttcccggcctgcgggcaaaggtgtggaggggctcgccagagtgggatcccgagcggcgctgtcttttgcctttgccttcctgcgcagggcctggcgatcaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacgggggatgttcacggaacgccagccaccaaagggccaggaagcatccccctgcaggaccagcacttggccctggccatcctgctggagctggctgtgcagagaggcacgctgagccaaatgttgtctgccatcctgttgttgcttcagctgtgggacagcggggcacaggagactgacaatgagcgttccgcccagggcaccagcgccccacttttgcccttgctgcaaaggttccagagcatcatttgcaggaaggatgcaccccactccgagggcgacatgcaccttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataagggatcattgcaagaggtcataggttgggggttaataggatggaaatactatgccaatgtgattggtccaatccagtgcgaaggcctggccaacctgggagtcacacagattgcctgtgcagagaagcgtttcctgattctgtcacgcaatggccgcgtgtacacacaggcctataatagtgacacgctggccccacagctggtccaaggccttgcctccagaaacattgtaaaaattgctgcccattctgatggtcaccactacctagccttggctgctactggagaggtgtactcctggggctgtggggacggcggacggctgggccatggggacactgtgcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggctccagtgaggacgaggccattccgatgctggtagccgggcttaaaggactgaaggtcatcgatgtggcgtgtgggagtggggatgctcaaaccctggctgtcactgagaacgggcaagtgtggtcttggggagatggtgactatgggaaattgggcagaggtggtagtgatggctgcaaaaccccaaagctgattgaaaagcttcaagacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccagagctttgcttggtcatcatgttctgagtggtccattggcctccgtgtcccttttgtggtggacatctgctcaatgacttttgagcagctggatctcctgcttcggcaggtgagtgaggggatggatggttccgcggactggcccccgccccaggagaaagagtgtgtggccgtggcaacgctgaatcttctacgacttcagttgcatgctgccattagtcaccaggttgacccggaattccttggtttaggtctgggcagcatcctcctgaacagcctgaagcagacggtggtgaccctggccagcagtgcgggcgtgctgagcaccgtgcagtcggccgcccaggccgtgctgcagagtggctggtccgtgctgctgcccaccgcggaggagcgggcccgggcactctctgctctcctgccctgcgcagtttcaggcaatgaagtgaacataagtccaggtcgtcgattcatgattgatcttctggtgggcagcttgatggctgatggagggttggagtcagccttacacgcagccattactgcagagatccaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttagaaacattgcttctcagactgtagccagattgaaagatgttgcccgtcggatttcatcatgtctggactttgagcaacacagtcgtgaaagatctgcttcattggatttgttactgcgttttcaacgtttgcttattagtaaactttatccaggagaaagtattggtcagacctcagatatttctagtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtgttctccttccagaactagtagtttctatagtgcttctgctcagtaaaaatgctggtctcatgcaagaggctggagctgtacctctgctgggtggcctgttggaacatctggatcggttcaaccatctggcaccaggaaaggaacgggatgatcatgaagagttagcctggcctggcataatggagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttgctcagtttgcaggggaagacccagtggtagctttggaagctgctttgcagtttgaagacacccgggaatccatgcacgcgttttgtgttggccagtatttggagcctgaccaagaaatcgtcaccataccagatctggggagtctctcttcacctctgatagacacagagaggaatctgggcctgcttctcggattacacgcttcgtatttggcaatgagcacaccgctgtctcctgtcgagattgaatgtgccaaatggcttcagtcatccatcttctctggaggcctgcagaccagccagatccactacagctacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgttgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccgttggaggaggatagctcaaaagataattcgagaacgaaggaaaaagagagttcctaagaagccagaatctacggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaaaatgagaaagtgcctactaaaacagttggagagagcagaggttcgcctggaagggatagatacaattttaaaactggcgagcaagaatttcttacttccatctgtgcagtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgtacagaacattcgaaatgttttgatggatgccagtgccaaatttaaagagcttggtatccagccggttcccctgcaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggatgggcctcctccaggcctaggccgcgtgattggtgagctgggagaggacggatggataagagtccagtgggacacaggcagcaccaactcctacaggatggggaaagaaggaaaatacgacctcaagctggcagagctgccggctgctgcacagccctcagcagaggattcggacacagaggatgactctgaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtggaagggcacgcacccttcactgccacctcgctgcagaggcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgctctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggctgctgcactggccgtttgccagtgcttggctgtggagtccactcacccttcgagcccaggatttgaagactgcagctccagtgaggccaccacgcctgtcgccgtgcagcacatccgccctgccagagtgaagaggcgcaagcagtcgcccgttcccgctctgccgatcgtggtgcagctcatggagatgggattttccagaaggaacatcgagtttgccctgaagtctctcactggtgcttccgggaatgcatccagcttgcctggtgtggaagccttggtcgggtggctgctggaccactccgacatacaggtcacggagctctcagatgcagacacggtgtccgacgagtattctgacgaggaggtggtggaggacgtggatgatgccgcctactccatgtctactggtgctgttgtgacggagagccagacgtacaaaaaacgagctgatttcttgagtaatgatgattatgctgtatatgtgagagagaatattcaggtgggaatgatggttagatgctgccgagcgtatgaagaagtgtgcgaaggtgatgttggcaaagtcatcaagctggacagagatggattgcatgatctcaatgtgcagtgtgactggcagcagaaagggggcacctactgggttaggtacattcatgtggaacttataggctatcctccaccaagttcttcttctcacatcaagattggtgataaagtgcgggtcaaagcctctgtcaccacaccaaaatacaaatggggatctgtgactcatcagagtgtgggggttgtgaaagctttcagtgccaatggaaaagatatcattgtcgactttccccagcagtctcactggactgggttgctatcagaaatggagttggtacccagtattcatcctggggttacgtgtgatggatgtcagatgtttcctatcaatggatccagattcaaatgcagaaactgtgatgactttgatttttgtgaaacgtgtttcaagaccaaaaaacacaataccaggcatacatttggcagaataaatgaaccaggtcagtctgcggtattttgtggccgttctggaaaacagctgaagcgttgccacagcagccagccaggcatgctgctggacagctggtcccgcatggtgaagagcctgaatgtgtcgtcctccgtgaaccaggcatcccgtctcattgacggcagcgagccctgctggcagtcatcggggtcgcaaggaaagcactggattcgtttggagattttcccagatgttcttgttcatagattaaaaatgatcgtagatcctgctgacagtagctacatgccgtccctggttgtagtgtcaggtggaaattccctgaataaccttattgaactaaagacaatcaatattaacccttctgacaccacagtgccccttctgaatgactgcacagagtatcacaggtatattgaaattgctataaagcagtgcaggagctcaggaatcgattgtaaaatccatggtctcatcctgctgggacggatccgtgcagaagaggaagatttggctgcagttcctttcttagcttcggataatgaagaggaggaggatgagaaaggcaacagcggaagcctcattagaaagaaggctgctgggctggaatcagcagctacgataagaaccaaggtgtttgtgtggggcctgaatgacaaggaccagctgggcgggctgaaaggctccaagataaaggttccttcgttctctgagacactgtcagctttgaatgtggtacaggtggctggtggatctaaaagtttgtttgcagtgactgtggaagggaaggtgtatgcctgtggagaagccacgaatggccggctggggctgggcatttccagcgggacggtgcccatcccacggcagatcacagctctcagcagctacgtggtcaagaaggtggctgttcactcaggtggccggcacgcgacggctttaactgtcgatggaaaagtgttttcgtggggcgaaggtgacgatggaaaacttggacacttcagcagaatgaactgtgacaaaccaaggctgatcgaggccctgaaaaccaagcgtatccgggatatcgcctgtgggagctcgcacagcgcagccctcacatccagcggagaactgtacacctggggcctcggcgagtacggccggctgggacatggggataatacgacacagctaaagcccaaaatggtgaaagtccttctcggtcacagagtaatccaggttgcatgtgggagtagagacgcgcagaccctggctctgaccgatgaaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggggaaagggggattacttcagattgggccacggctctgacgtgcacgtgcggaaaccacaggtggtggaagggctgagagggaagaagatcgtgcatgtggctgtcggggccctgcactgcctggcggtcacggactcggggcaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagaccctttaggtgcttcctatttaggcgtgccttcagatgctgattcttctgctgccagtaataaaataagtggtgcaagtaattctaagccaaatcgcccttctcttgccaagattctcttgtcattggatggaaatctggccaaacagcaggccttatcacatattcttacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtgccctagctgccagtcacagaatgtgggcccttcagagactgaggaagctgcttacaactgaatttgggcagtcaattaacataaataggctgcttggagaaaatgatggggaaacaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaagctgtatgccactgggtatggtgcaggtggcagactaggcattggagggacagagtcggtgtccaccccaacattgcttgaatccattcagcatgtgtttattaagaaagtagctgtgaactctggaggaaagcactgccttgccctgtcttcagaaggagaagtttactcttggggtgaggcagaagatgggaagttggggcatggcaacagaagtccgtgtgaccgccctcgtgtcatcgagtctctgagaggaattgaagtggtcgatgttgctgctggcggagcccacagcgcctgtgtcacagcagccggggacctctacacatggggcaaaggccgctacggccggctggggcacagcgacagtgaggaccagctgaagccgaagctggtggaggcgctgcagggccaccgtgtggttgacatcgcctgtggcagtggagatgcccagaccctctgcctcacagatgacgacactgtctggtcctggggggacggggactacggcaagctcggccggggaggcagcgatggctgtaaagtgcctatgaagattgattctcttactggtcttggagtagttaaagtggaatgcggatcccagttttctgttgcccttaccaaatctggagctgtttatacctggggcaaaggcgattatcacaggttgggccatggatcagatgaccatgttcgaaggcctcggcaggtccaagggttgcaggggaagaaagtcatcgccatcgccactggctccctgcactgtgtgtgctgcacagaggatggtgaggtttatacatggggcgacaatgatgagggacaactgggagacggaaccaccaatgccatccagaggcctcggttggtagctgcccttcagggtaagaaggtcaaccgtgtggcctgtggctcagcacataccctcgcctggtcgaccagcaagcccgccagtgctggcaaactccctgcacaggtccccatggagtacaatcacctgcaggagatccccatcattgcgctgaggaaccgtctgctgctgctgcaccacctctccgagctcttctgcccctgcatccccatgttcgacctggaaggctcgctcgacgaaactggactcgggccttctgttgggttcgacactctccgaggaattctgatatcccagggaaaggaggcggctttccggaaagtagtacaagcaactatggtacgcgatcgtcagcatggccccgtcgtggagctgaaccgcatccaggtcaaacgatcaaggagcaaaggcgggctggccggccccgacggcaccaagtctgtctttgggcagatgtgtgctaagatgagctcgtttggtcccgacagcctcctccttcctcaccgtgtctggaaagtcaagtttgtgggtgaatctgtggatgactgtgggggcggctacagcgagtccatagctgagatctgtgaggagctgcagaacggactcacgcccctgctgatcgtgacacccaacgggagggatgagtctggggccaaccgagactgctacctgctcagcccggccgccagagcacccgtgcacagcagcatgttccgcttcctgggtgtgttgctgggcattgccatccgaaccgggagtcccctgagcctcaaccttgccgagcctgtctggaagcagctggctgggatgagcctcaccatcgcggacctcagtgaggttgataaggattttattcctggactcatgtacatccgagacaatgaagccacctcagaggagtttgaagccatgagcctgcccttcacagtgccaagtgccagtggccaggacattcagttgagctccaagcacacacacatcaccctggacaaccgcgcggagtacgtgcggctggcgataaactatagactccatgaatttgatgagcaggtggctgctgttcgggaaggaatggcccgcgttgtgcctgttcccctcctctctctgttcaccggctacgaactggagacgatggtgtgtggcagccctgacatcccgctgcaccttctcaagtcggtggccacctataaaggcatcgagccttccgcatcgctgatccagtggttctgggaggtgatggagtccttctccaacacagagcgctctcttttccttcgcttcgtctggggccggacgaggctgcccaggaccatcgccgacttccggggccgagacttcgtcatccaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcgctcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgattttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccccctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaa

SEQ ID NO: 13383 - DNA, 3513 bp, Homo sapiens
tcagtagctgaggctgcggttccccgacgccacgcagctgcgcgcagctggttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgaaatgcattaaattaggaaaaaacatgaagatacattccgtggaccaaggagcagagcacatgctgattctctcatcagatggaaaaccatttgagtatgacaactatagcatgaaacatctaaggtttgaaagcattttacaagaaaaaaaaataattcagatcacatgtggagattaccattctcttgcactctcaaaaggtggtgagctttttgcctggggacagaacctgcatgggcagcttggagttggaaggaaatttccctcaaccaccacaccacagattgtggagcacctcgcaggagtacccttggctcagatttctgccggagaagcccacagcatggccttatccatgtctggcaacatttattcatggggaaaaaatgaatgtggacaactaggcctgggccacactgagagtaaagatgatccatcccttattgaaggactagacaatcagaaagttgaatttgtcgcttgtggtggctctcacagtgccctactcacacaggatgggctgctgtttactttcggtgctggaaaacatgggcaacttggtcataattcaacacagaatgagctaagaccctgtttggtggctgagcttgttgggtatagagtgactcagatagcatgtggaaggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttgaaagccatacctcagaaaaggagttaataatgattgctggagggaatcaaagcattttgctctggataaagaaagagaattcatatgttaatctgaagaggacaattcctactctgaatgaagggactgtaaagagatggattgctgatgtggagactaaacggtggcagagcacaaaaagggaaatccaagagatattttcatctcctgcttgtctaactggaagttttttaaggaaaagaagaactacagaaatgatgcctgtttatttggacttaaataaagcaagaaacatcttcaaggagttaacccaaaaggactggattactaacatgataaccacctgcctcaaagataatctgctcaaaagacttccatttcattctccaccccaagaagctttagaaattttcttccttctcccagaatgtcctatgatgcatatttccaacaactgggagagccttgtggttccatttgcaaaggttgtttgtaaaatgagtgaccagtcttcactggttctggaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaaaccaggtgaaatgtcaactacctgaaagtattttccaagtagacgaactcttgcaccgtctcaatttttttgtagaagtatgcagaaggtacttgtggaaaatgactgtggacgcttcagaaaatgtacaatgctgcgtcatattcagtcactttccatttatctttaataatctgtcgaaaattaaactactacatacagacacacttttaaaaatagagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaagcctaaatttgagaagaaaagatacttcttttttggggttctatgtggactttccctgttcaattgcaatgttgccaaccttcctttcccactggcactgtttaagaaacttttggaccaaatgccatcattggaagacttgaaagaactcagtcctgatttgggaaagaatttgcaaacacttctggatgatgaaggtgataactttgaggaagtattttacatccattttaatgtgcactgggacagaaacgacacaaacttaattcctaatggaagtagcataactgtcaaccagactaacaagagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaagaatgcacgttatgaaccaggatataacagttcacatcccaccatagtgatgttttggaaggctttccacaaattgactctggaagaaaagaaaaaattccttgtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaa

SEQ ID NO: 13384 - DNA, 5488 bp, Homo sapiens
gaggctttcgactgagggctagcgaggggagcacggctggagcagggctggagcagggctggagcagggctggagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcagggtacctcggctgaataaaaattcaaaaaacagcaatggacaggaactagagaagacgctggaagaaagcaaagaaatggatatc

SEQ ID NO: 13385 - DNA, 14692 bp, Homo sapiens
gaggctttcgactgagggctagcgaggggagcacggctggagcagggctggagcagggctggagcagggctggagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttc

SEQ ID NO: 13386 - DNA, 14796 bp, Homo sapiens
tccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaa

SEQ ID NO: 13387 - DNA, 4382 bp, Homo sapiens
caattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatgttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacaatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatc

SEQ ID NO: 13388 - DNA, 682 bp, Homo sapiens
ggtctcctgtggaatgatggaagccttattgaaggtcataaagtttcttggcgatgaacaggaccagataacatttgtcaccagagccgtcagagtggttgaccttatcaccaacctggatatggcagcttttcaatcccatagtggactttctatcttcatttatagacttgagcatgaagtagatttgtgccgaaaagaatgtccgtttgtgatcaagccaaagatccagagacccaatactacacaagaaggagaggaaatggaaactgatatggatgttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatac

SEQ ID NO: 13389 - DNA, 4805 bp, Homo sapiens
gccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaa

SEQ ID NO: 13390 - DNA, 11438 bp, Homo sapiens
cagcctaccatctgggtgtgaatttggccaggcagatatgcagaaactggttccaaaggatgagaaggcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatgatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactgcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgatagtcaggatgaagaggaggaggaggaggaagatgaggaagatgatcaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctacagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggaaccctgtccagcatccccacagccctgacccgctggacagaagaatgcaaagttctcgatgctgagagcatgcatgactgtgtttcagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacagtgtactgcatctaagtcaaatgactccactgaacagaatctctcagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataacctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacagctccccacctgcatcctctgagagctcttccaccagagattctgccgtggccatttctggagcagattcccgaggaatcctagaagagccgttgccttcaacaagcagtgaagaagaagatccccttgcgggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccggctttcaccagtcgcttaagtggcaaccgtggggtccagtatactcgccttgctgtgcagagaggtggcaccttccagatggggggtagcagcagccataacaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaatttctcccactactaagggcagcaaatctccagcgaaggtgagtgatgggggcagcagcagtacagactttaagatggtgtcctctggcctcactgaaaaccagctacagctctctgtagaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggttcctccggtttaggctcagctagcagcatccaggcagctgttcggcagctggaggctgaggctgatgccattatacaaatggtacgtgagggtcaaagggcgcggagacagcaacaagcagcaacgtcggagtctagccagtcagaggcgtctgtccggagggaggaatcacccatggatgtggaccagccatctcccagtgctcaagatactcaatccattgcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcagagactcaccgcactgtgttaaaccagatcctacggcagtccacgacccaccttgctgatgggccttttgctgtcctggtagactacattcgtgtcctcgactttgatgtcaagcgcaaatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcagatatacagatatggagagtgaagattaccacttctaccaaggtctggtttatctgctggaaaatgatgtctccacactaggctatgacctcaccttcagcactgaggtccaagagtttggagtttgtgaagttcgtgacctcaaacccaatggggccaacatcttggtaacagaggagaataagaaggagtatgtacacctggtatgccagatgagaatgacaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatgttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataaccccaa

SEQ ID NO: 13391 - DNA, 1053 bp, Homo sapiens
gaggctttcgactgagggctagcgaggggagcacggctggagcagggctggagcagggctggagcagggctggagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggaagtag

SEQ ID NO: 13392 - DNA, 872 bp, Homo sapiens
tccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttct

SEQ ID NO: 13393 - DNA, 3594 bp, Homo sapiens
aaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13394 - DNA, 1639 bp, Homo sapiens
aaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgctgccccgatgggaactggcactttacctacttgcctcactaggcttccacttctattccttctatgaagtttacaaagtctccagaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgc

SEQ ID NO: 13395 - DNA, 2714 bp, Homo sapiens
aaagtagaaaaaccttgtggttcttttggagtgaaagccttgtaataggccccttggggcatgctggggctcatttctagacagtgaggcgtgatgagcaggagagatgaagaaaatctgcttctcttgcaaagtaattccttcatgagacttcattaaaagggtcttcaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13396 - DNA, 3626 bp, Homo sapiens
agtgcgcccgggcaaaggcggggatctaggcgccgggacaagtccgcgcacggccctgcccacgtcctctctccttggcttcgtccccagcttccggaactgctgcggggagttgcgaactctggtcctcttggcagtatcggcggtgcgcctgcctgcctgctgtgactccagggactctaaaaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13397 - DNA, 1799 bp, Homo sapiens
acggcggcaggggcgtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggaggtttatttttattttttttactcaatccatgttgggagacagcattccagggctttcctgtgtttctgcatttcttacaaacagaggtactggctacctttgttcccaactatttttcctggaatatttgtatagaaaacacctccgaattgtccagctactaa

SEQ ID NO: 13398 - DNA, 3575 bp, Homo sapiens
ctcttggctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13399 - DNA, 721 bp, Homo sapiens
aacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggag

SEQ ID NO: 13400 - DNA, 3446 bp, Homo sapiens
acggcggcaggggcgtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13401 - DNA, 3164 bp, Homo sapiens
ctcttggctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagccatgctgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13402 - DNA, 3507 bp, Homo sapiens
acggcggcaggggcgtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatacttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggattttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattatgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 13403 - DNA, 1583 bp, Homo sapiens
gtgctcggaggacgcgcgctgcgctgctcctccaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctgtactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcaatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtccttgttgctggcctccaaggcaaatagtgcttcaccctgacctctcactccag

SEQ ID NO: 13404 - DNA, 10072 bp, Homo sapiens
tcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctagatgaaacacctttaccctgtcctgtaaaacactaaagttacatttttcaccaacttaattggaaagaaggggagtgagaaagcaaacagtctttaatgtgctgtggatctaatctagcaaggtatccttgtgccaacatgtaatcattaacgacggatgaaaaagcaagaaaacagccaatccttataaaattccagcattaaacatttgtaaagtgcttttcaccatagcaagactgtcagagtctatgttattagaatgttgcagatttccactgaatcgaacctcactggagaagagctcacttgtttttaaaaatcttggctatgtaagctgtcacctgtacaaatttttaacataataattcttgccaaatatgactttaaatgtacgtgttccttcagaactcaatgaaaatactctttggctaatgtatcaataaattttctgtaaatgttctgttcagggttttacagagatgacatgttctgacttaaaactgcaaaaagtctagtagatatttttcttcatggttttcaaagccagctctccacgtttggattttaacaaaatataaggcctctttgcactagtgaaaaaacacgtctactcatgacaagtgcacacccactatggctgtccttcttctgtaaacatccattcctctagaatctaaattgtagagcagtatagattatgcagcgccagctgactttctaaaccttctccttacctttaggaatacaagcctcaatttaaaaaatatattgtagctagtatttctctattgttttaaggtgagagatttgcaattaaagcccagtaagcatttatatagaagccacaatgtagaaagattggttaagtacactgctcttgtcttccatatatgattacttaagtttcaagtgacctcatgccaaatggaaatgggttgagaaatcttggttcagtgcttagtgaacaatagcctgcattaaaaagtgcatgcataattttgcacaatttagattcaattgacagtctattcaaagaagtctcaggattaaatgagcatggagaccaaattgccctcttaccccagaaaaggggtggtcccttctagtcacactaacacttcattggcccaacagtgtgacaaatcttgcaatgaaccatgcagtagcctgcatctgtaggttaatagcaatcttttgtctccattgctttctcttcatagcccttttactgaattccatcacagaaagttttacaattaaaaaaaaatgtcctgacaaccatttttgtaaatggaccttaccatctaattgtcccttattcaacgtgggtgacattaacaaaatgtgaacttcttgtgagggagccagctgtctaaatctgtcaaatcgtgcagttttattacacattctccaattcttcctagtttccctgaaaacaataaggatactgctatatattcagtaaaatctaaaaaaatcaagcattacttcttacatctttaaactttccatctcctccccaaaataaaaggtgttctattgccattagttctactgttttaaaatatctatattaagttgaccaggcccagattttttatacagctttttcccaagtgaaagattttcaagtgacttagaaaaacatatgtgccccaggtgtcattgccttttcttttgtgagtcattagaatgaaaggccaagttcttctcaagagaagatagcaagatccacggatattaagccaagcaaagaaagtaaaatcattggagtcatttctttctgttcttaggagaaaagtagatagcactggctaattgatggcaacatattttaaattaagtggtcaattcaaaaattctctttgaccttttctttcaagtagatttttttaaatgcatgactggagaattatcttcaatgattcatgatgagaggcaggtaggaattggttaagaagtatgagcaggaaaaaattattgtttaatcacatgaaaggcaacatctgttcagttcataaagcacacagtctcgaatggaagaaaaaaaggtccttcgtaagaatactgatgcataagataaagacgaaataatgaaaaagaaaaatgtatattattattcccttgtccattctcaagtttaagctgcggttgtcagttgaatgtgaaatgatgttatagttgttttaaatggttggaaataacctttctactactgtttctgccacactgttgtcctggttcatagaaccttgttttcttgacagttatttaaggtaataaaaggaacacaatttggcagatctttaagtgaaagagagaaaaaatttaagaaattgagtgatggctaaaagtaagtgcttccatccataacttttcttcttggatttttttcaatgtaattattgtaaaatatatttttttattttatcatgaagaatactcggaaggtttctcagattaatgagtatctcataaagagtagagaaaccaacacatacaatatatacacacaacctaaatagaaaactattttctttgtcatttgcatgccccagagaagttacttcttccctatttatttctttgaaaataattacaaaatagtatactaacaattttaatccatttgctgttttttttttttttttggtttctttttttttttttttgagacggagccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaccatgcccagcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgttacctatactgtcagtgttcacctcctctccctccctccttctctctctctctccccctctcgctctctcggctaatatatatgtgtatgtgtatatatatatgtatgtatatatatacacacacacacacacatacatacatacatacatatattctttttccttttaaccacttccctctcctacattttctattggttttgcctaaatagacatgttctcaatacacccatgttgaaggtatcctgggctagattgctgttgattttgctggttatgatcttttctttgtttttctgaaaaatagcctctcttgattccacattttctcaaattctatataacaaataatagtggatagtaaacaaatgacatactaggctgatctattacaatcattgaaagaaataaggaagagcagaaatcactaacagtccagaggctccaattcagctgctctagcatagatacaggaaagacatggagaataacactggggttagctaacagcagggaaagttagtagctatttcctagccaaggaacaaccttctctatggaataattttaagaaaattattccaaatctgtgaggaaaaaataagaagcagttcctcaatggagactttataaatcttaatttcctcacccctgggatgagatttgaagttgcagaggactcagaccaaagtcccatggcagaaaatgtacatatttttaaactactcccaggaagtaaactagtactgtgaatgctggcaataccatcagaaagtttatctttaaaatacctaaaaataaatatatatttgctatcttatcctctttttgtcacacaaacataaattggtcatatatatatttatatatatggttatatatatttggttatatatatatctttatatatatatcttatatatatatctttttatatatatcttatatatatatctttttatatatatcttatatatatatctttatatatatcttatatatatatcttatacatataagatatatgtatatatatatacattatatatatataatatatatatattatatatatataatatatatcttatatatatatatatcttaatacatatatataaccatggaacctgccaaacactaatcctagccaacttcaatccttctttctcttaactatcttctctgaataagttctggacttcaccttaaaataagtttttaggagagtaatatatattcatgggattgtgagggagcattgtagagctgttttcttctcagtcatagtggtggttttcctagctgctatggaaaggtttgttcacttatgagattaggacttttcttaaattcctcattaaatatgaacctaaggcatacccatcatttaccttgattcccatataatttgtataagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactagggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttga

SEQ ID NO: 13405 - DNA, 1770 bp, Homo sapiens
gaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaaggttggctttttaaattttatttatttttgtgctggctacgttaattttattttagtgttaccttcctcactgaaggtatttctttgtaataaaagaaagaatcttgcaggagaaaataagggggcaacataagaaacaataattatggcacctgaattaggacagtgacattaaatttctgttatttgttgactattgtgcgctgcaatcgaattgatatttgacatgctttccccatgtaattgacacatttaaaggaatctttggctttataaagtattgtttaaatattgtttaatgggcataacacaggactgtacatcagcatttgctagtagaaacaaagaggtcttttggttattttggcaattgcaaatcattctttcaccatctctgtttttgagtctgtctcataaaaaatactacttatactac

SEQ ID NO: 13406 - DNA, 9156 bp, Homo sapiens
ccgctgcccgctgcccgctgccctcgccccgcgcgccgggcatgtgagcgcgggcgggcgccgtcaccatggcctcgccgcgcgcctcgcggtggccgccgccgctcctgctgctgttgctgccgctgctgctgctgccgccggcggcccccgggacgcgggacccgccgccttccccggctcgccgcgcgctgagcctggcgcccctcgcgggagcggggctggagctgcagctggagcgccgcccggagcgcgagccgccgcccacgccgccccgggagcgccgcgggcccgcgacccccggccccagctacagggcccctgagccaggcgccgcgacacagcggggaccctccggccgggcccccagaggcgggagcgcggatgctgcctggaaacattggccagaaagtaacactgaggcccatgtagaaaacatcaccttctatcagaatcaagaggacttttcaacagtgtcctccaaagagggcgtgatggttcagacctctgggaagagccatgctgcttcggatgctccagaaaacctcactctactcgctgaaacagcagatgctagaggaaggagcggctcttcaagtagaacaaacttcaccattttgcctgttgggtactcactggagatagcaacagctctgacttcccagagtggcaacttagcctcagaaagtcttcacctgccatccagcagttcagagttcgatgaaagaattgccgcttttcaaacaaagagtggaacagcctcggagatgggaacagagagggcgatggggctgtcagaagaatggactgtgcacagccaagaggccaccacttcggcttggagcccgtcctttcttcctgctttggagatgggagagctgaccacgccttctaggaagagaaattcctcaggaccagatctctcctggctgcatttctacaggacagcagcttcctctcctctcttagacctttcctcatcttctgaaagtacagagaagcttaacaactccactggcctccagagctcctcagtcagtcaaacaaagacaatgcatgttgccaccgtgttcactgatggtggcccgagaacgctgcgatctttgacggtcagtctgggacctgtgagcaagacagaaggcttccccaaggactccagaattgccacgacttcatcctcagtccttctttcaccctctgcagtggaatcgagaagaaacagtagagtaactgggaatccaggggatgaggaattcattgaaccatccacagaaaatgaatttggacttacgtctttgcgttggcaaaatgattccccaacctttggagaacatcagcttgccagcagctctgaggtgcaaaatggaagtcccatgtctcagactgagactgtgtctaggtcagtcgcacccatgagaggtggagagatcactgcacactggctcttgaccaacagcacaacatctgcagatgtgacaggaagctctgcttcatatcctgaaggtgtgaatgcttcagtgttgacccagttctcagactctactgtacagtctggaggaagtcacacagcattgggagataggagttattcagagtcttcatctacatcttcctcggaaagcttgaattcatcagcaccacgtggagaacgttcgatcgctgggattagctacggtcaagtgcgtggcacagctattgaacaaaggacttccagcgaccacacagaccacacctacctgtcatctactttcaccaaaggagaacgggcgttactgtccattacagataacagttcatcctcagacattgtggagagctcaacttcttatattaaaatctcaaactcttcacattcagagtattcctccttttttcatgctcagactgagagaagtaacatctcatcctatgacggggaatatgctcagccttctactgagtcgccagttctgcatacatccaaccttccgtcctacacacccaccattaatatgccgaacacttcggttgttctggacactgatgctgagtttgttagtgactcctcctcctcctcttcctcctcctcctcttcttcttcttcagggcctcctttgcctctgccctctgtgtcacaatcccaccatttattttcatcaattttaccatcaaccagggcctctgtgcatctactaaagtctacctctgatgcatccacaccatggtcttcctcaccatcacctttaccagtatccttaacgacatctacatctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccagcttcacgttccctcggaacatctccttctccccaaaccacagttgtttccacggctgaagacttggctcccaaatctgccacctttgctgttcagagcagcacacagtcaccaacaacagtgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccatgtgcaacaatactcagggatcctttatctgcaaatgcccggttgggtaccagttggaaaaagggatatgcaatttggttagaaccttcgtgacagagtttaaattaaagagaacttttcttaatacaactgtggaaaaacattcagacctacaagaagttgaaaatgagatcaccaaaacgttaaatatgtgtttttcagcgttacctagttacatccgatctacagttcacgcctctagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagagcgggcagcttgtgcaagcggaagagtcccgaatgtgacaaagacacctccatctgcactgacctggacggcgttgccctgtgccagtgcaagtcgggatactttcagttcaacaagatggaccactcctgccgagcatgtgaagatggatataggcttgaaaatgaaacctgcatgagttgcccatttggccttggtggtctcaactgtggaaacccctatcagcttatcactgtggtgatcgcagccgcgggaggtgggctcctgctcatcctaggcatcgcactgattgttacctgttgcagaaagaataaaaatgacataagcaaactcatcttcaaaagtggagatttccaaatgtccccgtatgctgaataccccaaaaatcctcgctcacaagaatggggccgagaagctattgaaatgcatgagaatggaagtaccaaaaacctcctccagatgacggatgtgtactactcgcctacaagtgtaaggaatccagaacttgaacgaaacggactctacccggcctacactggactgccaggatcacggcattcttgcattttccccggacagtataacccgtctttcatcagtgatgaaagcagaagaagagactacttttaagtccaggagagagagggactcattgctctgagccagtcacctgggacctctgctcagaggaccgcaccaggaggctgcgcccaggatttgtcgggagccacgctgagtggcaagcaggaagagggacaggcatgcggggcgtgaccacagtggaggagacaggtggatgtggaaccacaggctgctcattcagcacctttgttgttactgtgaacgtgaatgtgggccagtatcaagagagtctctctgagtgactgcaccatggcactggcaccagggcgactattagccagggcagaccactagacttcagtgcagggacctggttttcccttcgtttgcactttagtaaattgggtgggaggtttccttttggatctgttttgagactgttccagaaagaaggcttcctttcccgagacacttccataggcagcaatttggtgattcatttgcagcaaaatactggcttgttaattattttcctgcccagcgcctgcgtgctaaacaacagatgaggatgagcgtaccactgaagtctgaagatgtcgccattgaacggacagtgttttcatatgtttctaggttgtcttatgctacagtttccaagccagcccccacagtgaggaaatgtgtgaggcaccgcacacaactgcaatgtgttttttaagtcaaggtgacacatgtatttaagattttttttttaaatctctttgcagttaaatctcactttttcaaacaagcctggatcagggcaaaacaacttatatttggttttagctggaggctcagcaggcagattgcaggcaggggggcacttttcatccatgagggcccagcctggggcctgggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagctcctgcagctcacctgagcccacagactaggcttcttggctccttccgcagcatgcctgctcacccccagaacccgcagctgtgggaagagccatgtagggaggctattcccaggcatacacttccactgccttcagctgacgtcacagctgacaaatcatctcctctatcggagccagaagacttcagctccacaaaatgaagtgttctgtcctgaaaacattcttgggaagaatcccaacatcgagaaaacggtgtcctgtgagttccaacaatgcttcttgttcatgggtttcttccgtatggagtggattaagagtgttttattttgttgttctaactgagaaaaaaaggaggcacccacaaggttgaggtcacacagtctccacagtttccaggaggcgtttgggggtggggaaggcacctccagagcatgaggctctaaggggacatgagtaaagcatgtctgtgacccagtgaggaagggagaggccagctgcactcctgcacggggttcctagctgcagaagggtcccgcctaggccgaggggaaacacctgatagcagaagaggcctggatgcacacctggcacgccgaggctctccgcccagacacagtgctccatgtcagcccctgcacctggggtgtgtgattcacgtgcacagatgccacaatcctgcaccaatatcccacagatgggggaaggtgagaggaaggggcaagtgatgtgtaactgctcaagagatgcttaaacctccatagagaggagccgggcgcaggggcatctgtgtgtcccgtcacacactgcagcagggaagggtggctggctggctccctggcatcagtggtttggtttaagctccagagggtcttattgccattgtcttttcctctgccccttgagccagcctaaggccctggagtctgtttctttaggcggatgaactgacatgctcctaccatgaccaggctctgggcaaggctcctcacagtatccttgagaggtgggcatggaagtgcccatttctcaggtacagaaaccttcagagaggataaatagcttgccctgtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaaaaaaaaaatgctgactacccttttgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaactaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcacctttgggtcacccaccacgtgtggctttttggtgcctgcatgaaactgtgttgccccctggtgagatgcccgggtgtcctgtaagccgatttaactctgcctgaggaagaggagctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggagtcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttca

SEQ ID NO: 13407 - DNA, 13829 bp, Homo sapiens
atgctttgtggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgctccatacccacaccatcaccatcctcacctccagcatcttcctcagccgcccctgggattacatcagccgccagtgagggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaagaaaagtttgtctaaaatgtatttaaaaagaaaaaaaaattgtaagtagcatttacatttattcaataatattaccacatgctgggtttctgtaccagaaatggccagttgatgtacaaatgtatgttatttttgcttaaattcatttaaattttttttaaaataaaggggcagcatcttctaaataagttttatcagctttttttttttttttggtgacacgatgctgcattctaaaacttttatagttttagactatgtatgatgtgttgttgtaatctccatccaccataggatagagttaaaggcattctttgcaggcatattttgtatgccactgttttttgaaatgtgaaaaaaacgttggcatacttagttattttttggacaagctacacttcaagcttgtttttaatgttaatttgatagtgtgtgtttttttttttaaacaaatcaagaagctgaaaaatttttaggattgttggtgcttagtagacttgataactattttaaaaatgcgtgaatttagtaaaattctttttttctcactatgcatgtgtaaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatccaaaggaagatgtttaccctcttgaaacttatggtcttgtcacacatttaaagcaatatatgtccttattttcctgaccttgtaatactacttttatatttcagaggtatctcgaaactacaatataaacttttaaaaaaaaataagatgaggctggggaacctttcgaatgaacccaatcttcctgatgatccattcaaaaacaggtttttggaagaccactttcgataggcaatcctataatcaaagtacatttttaaaatcaggttgtaaaatggcaaaggtaaagaaaaattactgacatttcttctatgattggagtttagtttatgttggccagctacaaccccttttaatcctcagacagtttgggataaaagagtgcctttggttaatggttagcaagctccaggataagcgctgcgtgcctcttgtattcagctctacctttctgctaagagtgcggttcatttgtgtgtggctttgcgttccaggctgtgggtctctgtgtaaggtggcagacatagacttgtaaactgcagacgtgttaatggttagcataaatcacagctggaaaactgagccggcaagttacagcaccactctttctctgtatgatgtcagatcaccacatttagcaatgtcaaattttactcaacattctttagtaggaagaaaagaagaaaaagttttgccacgtagctatgtgcttttaagtctgtgacaaaactcaagacatatccgaatgaaaattagatctctctgatgtgaggatgttatggaaaataattttcccatcagtgattatccaccccccagcccccatatacaggactacaacgcaagctagataaatgttcaaaagcaatctgataatatgaagacagaattgtcaagtcagggctttcagttgaccccttgtcatgaggttattgcctaattttctgttttctatacttgaatctttaaaaaatatcagtttttaaattatttatatttatatttagttaagggtcatggggtcgtgtatgcaccccatcaccttatataaatatgttgatgatggaagctttggataaggaagctattaagttgtcatgacatccttgttctaagcagttatttctaaaaactaaaaataatagctacttattggcccaccgctctgctgtgagtatatgagtacttctcattccttatttccatagccagtcaaggattctaacgctgcttccatctgatactcttcttagattctgcatcaaatgcttattttgacttacaacaagcttactcttcctcagcattacataatgccatctttccaaccatgctttaaagaacctgctctttacgcatagtatcttataacattttgaacacgtcttgtgtaagaatcattgcaagtttccatcaaaatgaggcgtgtcttctgagtacagctgatgttctttgggtattacttgagtagtagtagcaagtacccataaatcagatttatgaaacataacttatatgctaggttcaacccttatatatgcatatatatgtatagtatatgtatataaaatttttttccagaaaacttgatgatagctctcagataataccaagtattaccagcttccatttcttcagagcagatttttttctaagtgaggttaattgttcacataatgtctttttacatctttgtcctttgtatcactctgaagttttctttttcttgccagaatatttgtttcactttttaatttcagtgctacttgagattttctttttttttaacctgaaagacgatattttggatgatagagtttgtaaagtgagccttcatgctgaaaaaattcttttcatgatctaaaaatggtcttttgttacgatttgaagaacctcattccgtgtaacatggatattttcttgtgtgtctttaaagggggttttggttgtcatttgggcatatgctttgccaaattgttatagcagaactttgtttttgattaatcagtagttaattattgaccatttaaactaacatgaccttaattttcctttcctcacacagatgtgctttctatccaggtcattttttacacgtgaaataacaaactgctttgtgtagattttttttttttttaaatcatcagattttagaataagtttaggtttaatgtaaacatcaactggtcttttcagttcagagaactgcagaataagtaaaataagcagaattcccactgaataagcattacctaattaaacatagcaacatctaagaccaatttatgaaaatactctccttttttatggaggcattggagctgctgagaaagctaatgaatttcccaactttgggataattaatatatagtattgtgttgctctagtgtagttgattttatgtgtttaatatttttcatgtcaagagcaaagctgcagacgtaaaagatgtttctctagcccccttagctagagcgagccacctttgttaagagtcagggtgtgaagaacaatttcaagataaattttagtatttcaaccattgttattaagaaaattagacttactgaaatactcatttaaaaacagacaccttctatagcattgttttatagtggagttatttttaaaaagggaatcccagaaagaatctataaaaatacaaggttaaaactttaaatgtattgaaagatacaaattggtgctttcaaatgtcatgtaagctagccattgtgtttttttttttccctccagctcctcaatggtagtaatttgtcttttatgatttaccgtacattatttcttgctcaccatccccttaacatatgaaaatccttaatttctactgccgcgctatatgtcttcctgaatctcaaggtataaatgtcttaatggatctgatttgtctccactctttgccatctgatccacattcaaaccgcctagaaattagaaagaataggtaatgttctatctacgatttcttgttcaaaatatcacgtagtggtgccaatcacttacaaagacaccatctccatcttgaaagagtaactggcatgttagtcttgaaaatgctcattatgatatgctcctcacatttcccatctgcttgaggatggacatttattagctgagactttaaagctgctaaattcacactttctactttcatacctttttaatcagtaatgtcaagaccattgttgcaaggagtgaatcttactaaacacatcctgttattactttaaactagaatatgagattcaagagatttaaaaacaattttaatgtaacgtttaaaatttttgaaccaattgagaatgtctactttggagtgaagtttaaggaaacagtcaccagagtttctaaaaattttttggagggaggtacctaatagaagaatctagacttagaaatgtgaactgtggttaaataccaaacccagttccgcagtggtcgtctaaagcgtctaaaactggagtgttaagaaaacccagagacattcatatagtttcagttatcagagtattagaccagactttatttgcaatttgttcaacagagagattttattttgatacagatattaagcataaagcatagtaagttttatataattctatgagttcattaaacaatattatgaaattttcattatgttcgtggggagtctttttaactgtttctacctcatatatgaggtctcttctgtattttactttgcatactagcatgtgattgcctgccttagaactatgtagaggaggggaaatcgatattaccttttaagaaatttttgattttatgaagtgttttcattaatacttttttaatgtttgagaagtaaaggggaaagggtggcaaattacataggttgcaacacagagtagaagtcacatagtactatttacagatctgtcctgttttaagatttgagaattgtgaacaggatggagcaatggttctcaaacttcagccagtatcagaattgcctcgaggtcttgttaaaattcagatagctggacccacccccagcatttctgattttggtctggagcctgatgatttgcatttccaacaagtttccaggcgatgctgatgctgccagtccaggaaccacactttgaaaatcactgggtctgattctcgcagtttgaaagtctcagagaccttcagagtctgaacgtcttttcaaccatgtatttatttactcagtgtaaaaaactgatctctggagacatttttataaatctggtgccatgactggaacatttgtggagaaaggtctccatggagcgacaggccctttggattggccaccacccctcctcactctcacccctgctggggtctgcactgctcttccgcagtagggtgaaggagctctttggttttagggtgagtttgcttttgtgtacgctgctgcctggacatcagtctggaagctgtgcatttgtttggtgtgcttagggtcaatcttgatccacatgcatggaagtgagaatcctggaaagaagccatcagaatgccatgagagtgcacctagcatgtatcgaggcactaagtgcaggagtccctgtcctaagatggcagtgacatggagcatcgaaaaccacagataatccttaaataataaaataatagttttgtttttttttcttcggggcagagtctcgctctgttgccctggctggagtacagtggcatgatctcggctcactgcaacctccgcctcccggcttcaagtgattctcctgcctcagcctcccaagtagttgggactacaggcatgcgccaccacgcccagctaatttttgtattttttagtagagacggggtttcaccgtgttggccaggatggtctccatctcttgacctcatgatctgcccgcctcgggctcccaaagtgttgggattacaggcatgagccactgcgcctggcaaatgttttagtttttatggttattattattttttttttttgtgggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaatgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcagtgaagttcttttgttttcaaagattcatggtaacaaaatgtattttactgctacaactaaaatgtatttataataaaatgcctttttaataatttgg

SEQ ID NO: 13408 - DNA, 1529 bp, Homo sapiens
caagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgaaaaaaaaaaaaaaaaaaaaaaaaaaaaaaaaaaaaaaaaaaaaaagaaa

SEQ ID NO: 13409 - DNA, 2561 bp, Homo sapiens
atgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagagactgttatgaagatttaaaaacttgtgcaaattgagagaatacagaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaa

SEQ ID NO: 13410 - DNA, 3099 bp, Homo sapiens
ggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatga

SEQ ID NO: 13411 - DNA, 2655 bp, Homo sapiens
atgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccaggaaagaattcctagaatgtatgtgtcagagtttacagatgagggcttctttgaaggcaaattgccctccagaaaagatttatatgatatacgtccatatgaaaatacttatttactcaagcttcataccaattttgagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaa

SEQ ID NO: 13412 - DNA, 3033 bp, Homo sapiens
ggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 13413 - DNA, 1053 bp, Homo sapiens
ggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattgatatatttgtga

SEQ ID NO: 13414 - DNA, 2804 bp, Homo sapiens
ggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatg

SEQ ID NO: 13415 - DNA, 711 bp, Homo sapiens
aggagaagcgcgcttttttccctggcgggggatttggctagaaggctgggccggcagcggttgtgaggagttagctcgcggcattgcaggctctgagaggaggggacccggttcccgggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatatactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcag

SEQ ID NO: 13416 - DNA, 2000 bp, Homo sapiens
agtttctcactccgaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcacacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtacccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctgtatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgaaccttctttctgttcagtcctaaaattcgaaataaagtgagactatggttcacctgta

SEQ ID NO: 13417 - DNA, 1636 bp, Homo sapiens
acttactcgtcatataaacccaaggcacagtcacatacccagggatacaagacactgcagactcccgagagacataacacagaattgcaccatgccaaactacaaactcacttattttaatatgagggggagagcagaaattattcgttacatatttgcttatttggacatacagtatgaagaccacagaatagaacaagctgactggcctgaaatcaaatcaactctcccatttggaaaaatccccattttggaagttgatggacttactcttcaccagagcctagcaatagcaagatatttgaccaaaaacacagatttggctggaaacacagaaatggaacaatgtcatgttgatgctattgtggacactctggatgatttcatgtcatgttttccttgggcagagaaaaagcaagatgtgaaagagcagatgttcaatgagctgctcacgtataatgcgcctcatcttatgcaagacttggacacatatttaggggggagagaatggcttattggtaactctgtaacttgggcagacttctactgggagatttgcagtaccacacttttggtctttaagcctgacctgttagacaaccatccaaggctggtgactttacggaagaaagtccaagccattcctgccgtcgctaactggataaaacgaaggccccaaaccaaactctagctgatccatgttgccttcaagtttgtttttctcgggggcatctctctcatcagataagacagctacatcagcctgccagataatccacatgctccctccccagctccactaagattttcactttagccatattctgatttttaaaaaggaaaataaaaacaaatctttcttcagtatctttttctttcagaatagcttctcatcatttacaattacagaaaaatagtatgtaatacaggcagaccttgctttgcacaggttctaacatgcacgaattgcagtcataatggtttagcaacaccattcttcccctcccccaaaatgttttggacttcagctaccacaattacctgtaattgcataaaacacaaactttgctagtagctctccagttcacatatcgctgtgtaaataacctatgtacatcatgaccaatgaccagtcacttctatcaaagactgccagaggtcactgcacatctgttattcctgcatagatagcaaagtgtgtagttgtattgctattgcctgcttgtggcccagtgataaatccctttgacattttacaaaaatgaatcaaaagagggaactccccaacaaagatgaaagtgcagcaaaggaacaaaaactgataatcctggaatgaaattcaaactgaatataaagagttatcgagaaaagagctgactgtgggaatctgacacggctcaaaaggctctagatatgcagccagagaaacttgtaaagatgaatttactgacatgaataaagttgttgtgatgagaaaaatgtagataccccagagatcaagagaaggagaagacaagccacagacttggagaaaatacttgtaaaacatgtatctgacaaaagactattattcaaaattatatagaactcataaaactcggctgactctcttttcggactcagcccacctgcaccc

SEQ ID NO: 13418 - DNA, 3490 bp, Homo sapiens
caatgttcgttatccttccagagatagtttatatcatggagtaatataaaaatttatgatttatatgtactgtataatagagcaattatattcttacctacccccaacatgctttaactcgaatgatagtgtagtacacttctgagtttgtctgggcttgtagctcttgtctgtcattagattctgaaagatacctattaacaataccctaaaaagatcaggagcctttaggccaagtctcaaacgtttcagatgagaaaaactcagggatggtgacttgacggaagttgcattaactaacaacgctcacatgctattctccggacttggaatgtccaagcaccctgggcttgctgacacccactcacttttcaaacatcaattcttgggaagcttttcccttccttaatgtcccccagataggtgatgtccccttgttacaggttttagaccattatgtacatctccttcctagcacatacatatattaaaatttgtttcctgtctccatgaggagagggactacatctgtccttttcactgctggcacacagtagttgctcaacaaaaatgtgcgaagtgaaactcgaacaggcggtcaggctcacagtccacgcctcttcctactgtggtcccgctgtgtttggacaaatagttccaaattataaactttaaaacctgagaagtctcaatagaaaaagcagggaagtctttccatttccatgattaatggaggaccttagcagaaacggctcaccgcgaggtgtgacgaccgcaggagggcgtcaatcaagaaaatgcccccttgccccggaggcgagtggagccgcacagagccgaggccatacgggccagcagtacggactgcttcaatagaaaacacgtgcaaaaccagagagccagactgcgcacagctgcgaccctcaagagccagcagaaaagacacggagcggcccccactggattgaagactgcacagcctctgcccggcgctgtaggacccgggcctccccttgattgctgctcgcagcggcttctgccagcatcctcgcggaagtggcttgagtccgaggcctccaaatgaaaccaggtggagcggccaagagtccgcagcacctgaactccagccatccgaatcccgccgggccgcagctaagggccgccgagcagccctaggaacccagggcactgtcccgctctgagctcgggaaacggccggtgtgacagccagcgccactgttaatccagggagcgcacccaccgaggaggcgtcttaggccagcggcctctgctcccgccgagtcccgctgctccccgcctggaaacagctgctgccaccccgggcccaggcctggacggcgcccccgaatttcggcagaggtgcctcggggccgcggacagggccgctggagcccgcactccagaaggcggtcttcctcgcgcctcccccgacggacgcggcccagggcttccctcgagggcgtcctcggccggggtgcctggagtccccaggggcgacagccgcggcggggcaccagggcgccagttccccggagcctggtagcaagcgcgtcccgggggcggggagcttggccggcggggcgggccggggtgggggcgggcggctgctcttggggccccgcgccattggccgcagggcccggcggcaggaaggggccagcgagcgcggccccaccccgcggccggcggagcctatcgccgggagcgcggagcgcggataaatgtagcgccgcggcgcgggccagcagctctgcgaggggccggagcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacctcgt

SEQ ID NO: 13419 - DNA, 1173 bp, Homo sapiens
ctcgccgcctcgccgtcccgccgccttgccgccctgccaccctgccgccctgccgccctgccgccctgccgccctgccgccggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaaggcggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggcacagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacagtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaacagctgagacaaa

SEQ ID NO: 13420 - DNA, 1692 bp, Homo sapiens
gccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 13421 - DNA, 1644 bp, Homo sapiens
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaagatggagtctcgctctgttgcccaggctggagtgcagtggatcagtctagctcattgcagcctccacctcctgggttcaagagattctcctgcctcagcctcctgtgtagctgggattacagagtcttactttgtcggccaggctggagtgcagtggcatgatctcgactcactgcaacctctgtctcccaggctcaagaaatcctcctacatcagcctcccaagtagctgggattacaggctggagtgcagtggctccatctcggctcactgcaacctccgcctcccaggttcaagcgattctcctgcctcagcctcctgagtagctgggattacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctag

SEQ ID NO: 13422 - DNA, 1712 bp, Homo sapiens
gtgagtttgtgtaaatccagttagaccaaaatgagcgaggtggagagcctcttaaccggatgctacgggtgatgactgggaggaggagaaaaattacctctttatcttgcatgaacatcttaattttcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 13423 - DNA, 1752 bp, Homo sapiens
attgtccactaaggtctggcaggtctgattgcctcttttcaggcactgagtggtggggtatgccatcctcccctgctggaaccagccttggcctgccctgttagtcatcaaaaatagatctcaccagggaacaatcttctcaggttgttgtgtaatttgagtgagccaaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 13424 - DNA, 1848 bp, Homo sapiens
catctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagct

SEQ ID NO: 13425 - DNA, 2147 bp, Homo sapiens
caaaactcggtctcaaaaaaagaaaaatcattctgtcattctggccgctgtttgaagaatgcgaataatgcaacagggagatcagatacaagactggtaaccgaggtgtcagagttgagactcagtttcgcagattgcattggcaagtgaccaagtgggtggtgccacggttgacaaccctatttcttacatcactgagtggatgtacaaggattaaaccacactggggaagaaaagtgctcaaccctgaggcaccctcacacacctcggctcttgtgaacactagtgttcctgccgaagcacgcctacttaccccgctgagcagagcctgagcctgcaacctccagagacctggggaaagccacatactccgcttcccgcccccggcaagggcgtgtcagctacaaggggcgtgtcatctctaggccccgccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcaatgtcagcggaagtggaaacctcagagggggtagacgagtcagaaaaaaagaactctggggccctagaaaaggagaaccaaatgagaatggctgacctctcggagctcctgaaggaagggaccaaggaagcacacgaccgggcagaaaacacccagtttgtcaaggacttcttgaaaggcaacattaagaaggagctgtttaagctggccaccacggcactttacttcacatactcagccctcgaggaggaaatggagcgcaacaaggaccatccagcctttgcccctttgtacttccccatggagctgcaccggaaggaggcgctgaccaaggacatggagtatttctttggtgaaaactgggaggagcaggtgcagtgccccaaggctgcccagaagtacgtggagcggatccactacatagggcagaacgagccggagctactggtggcccatgcatacacccgctacatgggggatctctcggggggccaggtgctgaagaaggtggcccagcgagcactgaaactccccagcacaggggaagggacccagttctacctgtttgagaatgtggacaatgcccagcagttcaagcagctctaccgggccaggatgaacgccctggacctgaacatgaagaccaaagagaggatcgtggaggaggccaacaaggcttttgagtataacatgcagatattcaatgaactggaccaggccggctccacactggccagagagaccttggaggatgggttccctgtacacgatgggaaaggagacatgcgtaaatgccctttctacgctgctgaacaagacaaaggtgccctggagggcagcagctgtcccttccgaacagctatggctgtgctgaggaagcccagcctccagttcatcctggccgctggtgtggccctagctgctggactcttggcctggtactacatgtgaagcacccatcatgccacaccggtaccctcctcccgactgaccactggcctacccctttctccagccctgactaaactaccacctcaggtgactttttaaaaaatgctgggtttaagaaaggcaaccaataaaagccagatgctagagcctctgcctgacagcatcctctctatgggccatattccgcactgggcacaggccgtcaccctgggagcagtcggcacagtgcagcaagcctggcccccgacccagctctactccaggcttccacacttctgggccctaggctgcttccggtagtccctgtttttgcagtacatgggtgactatctcccctgttggaggtgagtggcctgtaagtccaagctgtgcgagggggccttgctggatgctgctgtacaacttctgggcctctcttggaccctgggagtgagggtgggtgtgggtggaagcctcagaggccttgggagctcatccctctcacccagaatccctctaaccccttgggtgcggtttgctcagccccagcttatctcctcctccgcgctgtgtaaatgctccagcactcaataaagtgggctttgcaagcta

SEQ ID NO: 13426 - DNA, 18208 bp, Homo sapiens
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaagagggggaaaaaaaagaaaatgatttcctgggaagttgtccatacagtattcctgtttgctcttctttattcttccctagctcaagatgcgagcccccagtcagagatcagagctgaggaaattcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgaacttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatctggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaatgaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatattccacctagtattaaaggaggaaatgtcaccacagacatatcagtattgatcaacagccttattaaactggaatgtgaaacacggggacttccaatgcctgccattacttggtataaggacgggcagccaatcatgtccagctcacaagcactttatattgataaaggacaatatcttcatattcctcgagcacaggtctctgattcagcaacatatacgtgtcatgtagccaatgttgctggaactgctgaaaaatcattccatgtggatgtctatgttcctccaatgattgaaggcaacttggccacgcctttgaataagcaagtagttattgctcattctctgacactggagtgcaaagctgctggaaacccttctcccattctcacctggttgaaagatggtgtacctgtgaaagctaatgacaatatccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatcgtctactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtgcacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccataacctggttcaaagatgggtggcctgtcagccttagcaattctgtgaggattctttcaggaggcaggatgctacggctgatgcagaccacaatggaagatgctggccaatatacttgcgttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcaagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggacattaatgaatgtgaacaagtgcctaaaccttgtgcacatcagtgctccaacacccccggcagcttcaagtgtatctgtccaccaggacaacatttattaggggacgggaaatcttgcgctggattggagaggctgccaaattatggcactcaatacagtagctataaccttgcacggttctcccctgtgagaaacaactatcaacctcaacagcattacagacagtactcacatctctacagctcctactcagagtatagaaacagcagaacatctctctccaggactagaaggactattaggaaaacttgccctgaaggctctgaggcaagccatgacacatgtgtagatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacagatttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataa

SEQ ID NO: 13427 - DNA, 17861 bp, Homo sapiens
gaagccgcatccagacaaaagctgccgcatccctgccctgcccaacccctggagggattcgagtttggtgcttgtccccgtctgattctcagcgccaaactttttgctagttcagagattccaagagtctgatgagttactctgagaggaaaccctctgcctgttgttgaggaggactgagcacagtgcttaggcgctgagggggaaaaagagggggaaaaaaaagaaaatgatttcctgggaagttgtccatacagtattcctgtttgctcttctttattcttccctagctcaagatgcgagcccccagtcagagatcagagctgaggaaattcccgagggggcctccacgttggcttttgtgtttgatgtgactggttctatgtatgatgatttagttcaggtgattgaaggggcttccaaaattttggagacgtctttgaaaagacctaaaagacctcttttcaactttgcgttggtgcctttccatgatccagaaattggcccagtgacaattaccacagatcccaagaaatttcaatatgaactcagagaactgtatgttcagggtggtggtgattgcccagaaatgagtattggagctataaaaattgccttggaaatttctcttcctggttctttcatctatgttttcactgatgctcggtccaaagattaccggctcacccatgaggtgctgcaacttatccaacagaaacagtcacaagtcgtatttgttctgactggagattgtgatgacaggacccatattggatataaagtctatgaagaaattgcctctacaagttctggtcaagtgttccatctggacaaaaaacaagttaatgaggtattaaaatgggtagaagaagcagtacaggcctccaaagttcaccttttatccacagatcatttggaacaggctgtaaatacttggagaattccttttgatcccagcctgaaagaggtcactgtgtctttgagtgggccttctccaatgattgaaattcgcaatcctttagggaagctgataaaaaagggatttggcctgcatgagctattaaatatccataactctgccaaagtagtgaatgtgaaagagccagaggctggaatgtggacagtgaagacctcaagcagtggaaggcactctgttcgcattactggcctcagtactattgatttccgagctggcttttctcgaaagcccaccctggacttcaaaaaaacagtcagcagaccagtgcaaggaatacctacctatgtactgctcaatacttctggaatttccactccagctagaatagatcttcttgaacttttgagtatctcaggaagttctcttaagactattcctgttaaatattacccacatcgaaaaccttatggcatatggaatatttctgactttgtaccaccaaatgaagctttctttctcaaagtaacaggctatgataaagatgattacctcttccagagagtatcaagtgtttccttttctagtattgtcccagatgctcccaaagttacgatgcctgagaaaaccccaggatactatctgcagccgggccaaattccctgctctgttgacagtcttttgccctttaccttgagctttgtcagaaatggagttacacttggagtagaccagtatttgaaagaatctgccagtgtgaacttagatattgcaaaggtcactttgtctgacgaaggtttctatgaatgcattgctgtcagcagtgcaggtactggacgggcacagacattttttgacgtatcagagccccctccggtcatccaagtgcctaacaatgttacagtcactcctggagagagagcagttttaacatgtctcatcatcagtgcggtggattacaatctaacctggcagaggaatgacagagatgtcagactggcagagccagcgagaattaggaccttggctaatctgtcattggagctaaagagtgtgaaattcaacgatgctggagagtatcattgtatggtttctagtgaaggtggatcatcagccgcttcagttttcctcacagtgcaagaaccacccaaagtcactgtgatgcccaagaatcagtctttcacaggagggtctgaggtctccatcatgtgttctgcaacaggttatcccaaaccaaagattgcctggaccgttaacgatatgtttatcgtgggttcacacaggtataggatgacctcagatggtaccttatttatcaaaaatgcagctcccaaagatgcagggatctatggttgcctagcaagtaattcagctggaacagataaacagaattctactctcagatacattgaagcccctaagttgatggtagttcagagtgagctcttggttgcccttggggatataaccgttatggaatgcaaaacctctggtattcctccacctcaagttaaatggttcaaaggagatcttgagttgaggccctcaacattcctcattattgaccctctcttgggacttttgaagattcaagaaacacaagatctggatgctggcgattatacctgtgtagccatcaatgaggctggaagagcaactggcaagataactctggatgttggctcacctccagttttcatacaagaacctgctgatgtgtctatggaaattggctcaaatgtgacattaccttgttatgttcagggttatccagaaccaacaatcaaatggcgaagattagacaacatgccaattttctcaagacctttttcagttagttccatcagccaactaagaacaggagctctctttattttaaacttatgggcaagtgataaaggaacctatatttgtgaagctgaaaaccagtttggaaagatccagtcagagacaacagtaacagtgaccggacttgttgctccacttattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccacaaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtccaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctagttccacccaccataataggtaccaacttcccaaatgaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaatgcacggagaaatgacaaggggcgctaccaatgtactgtgtctaatgcagctggcaaacaagccaaggatataaaactgactatctatattccacctagtattaaaggaggaaatgtcaccacagacatatcagtattgatcaacagccttattaaactggaatgtgaaacacggggacttccaatgcctgccattacttggtataaggacgggcagccaatcatgtccagctcacaagcactttatattgataaaggacaatatcttcatattcctcgagcacaggtctctgattcagcaacatatacgtgtcatgtagccaatgttgctggaactgctgaaaaatcattccatgtggatgtctatgttcctccaatgattgaaggcaacttggccacgcctttgaataagcaagtagttattgctcattctctgacactggagtgcaaagctgctggaaacccttctcccattctcacctggttgaaagatggtgtacctgtgaaagctaatgacaatatccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacaggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatcgtctactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtgcacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatgctcctccaagcatcataggaaaccacaggtcacctgaaaatattagtgtggtagaaaagaactcagtatctttgacttgtgaagcttctggaattcccctgccttccataacctggttcaaagatgggtggcctgtcagccttagcaattctgtgaggattctttcaggaggcaggatgctacggctgatgcagaccacaatggaagatgctggccaatatacttgcgttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacattccacccataatcaataaaggggacctttgggggccaggtctttcccctaaagaagtgaagatcaaagtaaacaacactctgaccttggaatgtgaagcgtatgcaattccttctgcctccctcagctggtacaaggatggacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcaagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagaaccacctcacattaatggatctgaagaacatgaagagatatcagtaattgttaataacccacttgaacttacctgcattgcttctggaatcccagcccctaaaatgacctggatgaaagatggccggccccttccacagacggatcaagtgcaaactctaggaggaggagaggttcttcgaatttctactgctcaggtggaggatacaggaagatatacatgtctggcatccagtcctgcaggagatgatgataaggaatatctagtgagagtgcatgtacctcctaatattgctggaactgatgagccccgggatatcactgtgttacggaacagacaagtgacattggaatgcaagtcagatgcagtgcccccacctgtaattacttggctcagaaatggagaacggttacaggcaacacctcgagtgcgaatcctatctggagggagatacttgcaaatcaacaatgctgacctaggtgatacagccaattatacctgtgttgccagcaacattgcaggaaagactacaagagaatttattctcactgtaaatgttcctccaaacataaaggggggcccccagagccttgtaattcttttaaataagtcaactgtattggaatgcatcgctgaaggtgtgccaactccaaggataacatggagaaaggatggagctgttctagctgggaatcatgcaagatattccatcttggaaaatggattccttcatattcaatcagcacatgtcactgacactggacggtatttgtgtatggccaccaatgctgctggaacagatcgcaggcgaatagatttacaggtccatgttcctccatctattgctccgggtcctaccaacatgactgtaatagtaaatgttcaaactactctggcttgtgaggctactgggataccaaaaccatcaatcaattggagaaaaaatgggcatcttcttaatgtggatcaaaatcagaactcatacaggctcctttcttcaggttcactagtaattatttccccttctgtggatgacactgcaacctatgaatgtactgtgacaaacggtgctggagatgataaaagaactgtggatctcactgtccaagttccaccttccatagctgatgagcctacagatttcctagtaaccaaacatgccccagcagtaattacctgcactgcttcgggagttccatttccctcaattcactggaccaaaaatggtataagactgcttcccaggggagatggctatagaattctgtcctcaggagcaattgaaatacttgccacccaattaaaccatgctggaagatacacttgtgtcgctaggaatgcggctggctctgcacatcgacacgtgacccttcatgttcatgagcctccagtcattcagccccaaccaagtgaactacacgtcattctgaacaatcctattttattaccatgtgaagcaacagggacacccagtcctttcattacttggcaaaaagaaggcatcaatgttaacacttcaggcagaaaccatgcagttcttcctagtggcggcttacagatctccagagctgtccgagaggatgctggcacttacatgtgtgtggcccagaacccggctggtacagccttgggcaaaatcaagttaaatgtccaagttcctccagtcattagccctcatctaaaggaatatgttattgctgtggacaagcccatcacgttatcctgtgaagcagatggcctccctccgcctgacattacatggcataaagatgggcgtgcaattgtggaatctatccgccagcgcgtcctcagctctggctctctgcaaatagcatttgtccagcctggtgatgctggccattacacgtgcatggcagccaatgtagcaggatcaagcagcacaagcaccaagctcaccgtccatgtaccacccaggatcagaagtacagaaggacactacacggtcaatgagaattcacaagccattcttccatgcgtagctgatggaatccccacaccagcaattaactggaaaaaagacaatgttcttttagctaacttgttaggaaaatacactgctgaaccatatggagaactcattttagaaaatgttgtgctggaggattctggcttctatacctgtgttgctaacaatgctgcaggtgaagatacacacactgtcagcctgactgtgcatgttctccccacttttactgaacttcctggagacgtgtcattaaataaaggagaacagctacgattaagctgtaaagctactggtattccattgcccaaattaacatggaccttcaataacaatattattccagcccactttgacagtgtgaatggacacagtgaacttgttattgaaagagtgtcaaaagaggattcaggtacttatgtgtgcaccgcagagaacagcgttggctttgtgaaggcaattggatttgtttatgtgaaagaacctccagtcttcaaaggtgattatccttctaactggattgaaccacttggtgggaatgcaatcctgaattgtgaggtgaaaggagaccccaccccaaccatccagtggaacagaaagggagtggatattgaaattagccacagaatccggcaactgggcaatggctccctggccatctatggcactgttaatgaagatgccggtgactatacatgtgtagctaccaatgaagctggggtggtggagcgcagcatgagtctgactctgcaaagtcctcctattatcactcttgagccagtggaaactgttattaatgctggtggcaaaatcatattgaattgtcaggcaactggagagcctcaaccaaccattacatggtcccgtcaagggcactctatttcctgggatgaccgggttaacgtgttgtccaacaactcattatatattgctgatgctcagaaagaagatacctctgaatttgaatgtgttgctcgaaacttaatgggttctgtccttgtcagagtgccagtcatagtccaggttcatggtggattttcccagtggtctgcatggagagcctgcagtgtcacctgtggaaaaggcatccaaaagaggagtcgtctgtgcaaccagccccttccagccaatggtgggaagccctgccaaggttcagatttggaaatgcgaaactgtcaaaataagccttgtccagtggatggtagctggtcggaatggagtctttgggaagaatgcacaaggagctgtggacgcggcaaccaaaccaggaccaggacttgcaataatccatcagttcagcatggtgggcggccatgtgaagggaatgctgtggaaataattatgtgcaacattaggccttgcccagttcatggagcatggagcgcttggcagccttggggaacatgcagcgaaagttgtgggaaaggtactcagacaagagcaagactttgtaataacccaccaccagcgtttggtgggtcctactgtgatggagcagaaacacagatgcaagtttgcaatgaaagaaattgtccaattcatggcaagtgggcgacttgggccagttggagtgcctgttctgtgtcatgtggaggaggtgccagacagagaacaaggggctgctccgaccctgtgccccagtatggaggaaggaaatgcgaagggagtgatgtccagagtgatttttgcaacagtgacccttgcccaacccatggtaactggagtccttggagtggctggggaacatgcagccggacgtgtaacggagggcagatgcggcggtaccgcacatgtgataaccctcctccctccaatgggggaagagcttgtgggggaccagactcccagatccagaggtgcaacactgacatgtgtcctgtggatggaagttggggaagctggcatagttggagccagtgctctgcctcctgtggaggaggtgaaaagactcggaagcggctgtgcgaccatcctgtgccagttaaaggtggccgtccctgtcccggagacactactcaggtgaccaggtgcaatgtacaagcatgtccaggtgggccccagcgagccagaggaagtgttattggaaatattaatgatgttgaatttggaattgctttccttaatgccacaataactgatagccctaactctgatactagaataatacgtgccaaaattaccaatgtacctcgtagtcttggttcagcaatgagaaagatagtttctattctaaatcccatttattggacaacagcaaaggaaataggagaagcagtcaatggctttaccctcaccaatgcagtcttcaaaagagaaactcaagtggaatttgcaactggagaaatcttgcagatgagtcatattgcccggggcttggattccgatggttctttgctgctagatatcgttgtgagtggctatgtcctacagcttcagtcacctgctgaagtcactgtaaaggattacacagaggactacattcaaacaggtcctgggcagctgtacgcctactcaacccggctgttcaccattgatggcatcagcatcccatacacatggaaccacaccgttttctatgatcaggcacagggaagaatgcctttcttggttgaaacacttcatgcatcctctgtggaatctgactataaccagatagaagagacactgggttttaaaattcatgcttcaatatccaaaggagatcgcagtaatcagtgcccctccgggtttaccttagactcagttggacctttttgtgctgatgaggatgaatgtgcagcagggaatccctgctcccatagctgccacaatgccatggggacttactactgctcctgccctaaaggcctcaccatagctgcagatggaagaacttgtcaagatattgatgagtgtgctttgggtaggcatacctgccacgctggtcaggactgtgacaatacgattggatcttatcgctgtgtggtccgttgtggaagtggctttcgaagaacctctgatgggctgagttgtcaagatattaatgaatgtcaagaatccagcccctgtcaccagcgctgtttcaatgccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatcccaggacaactttcctcatggtagatgaggaacagactgttccttttgccttgagggatgaaaacctgaaaggagtggtgtatacaacacgaccactacgagaagcagagacctaccgcatgagggtccgagcctcatcctacagtgccaatgggaccattgaatatcagaccacattcatagtttatatagctgtgtccgcctatccatactaaggaactctccaaagcctattccacatatttaaaccgcattaatcatggcaatcaagcccccttccagattactgtctcttgaacagttgcaatcttggcagcttgaaaatggtgctacactctgttttgtgtgccttccttggtacttctgaggtattttcatgatcccaccatggtcatatcttgaagtatggtctagaaaagtcccttattattttatttattacactggagcagttacttcccaaagattattctgaacatctaacaggacatatcagtgatggtttacagtagtgtagtacctaagatcattttcctgaaagccaaaccaaacaacgaaaaacaagaacaactaattcagaatcaaatagagtttttgagcatttgactatttttagaatcataaaattagttactaagtattttgatcaaagcttataaaataacttacggagatttttgtaagtattgatacattataataggacttgcctattttcatttttaagaagaaaaacaccactcattttataaaatatagtacagctactataaggcttgtttgatcccaaatggtgcttatcttgattgaacattcagaacaaggatattattttcagtgattttgtgagatcagctgaaccacttatgataataataataaaaaagactgctttgccctcacgtcagttgtacatggcatggaactttaaaaattttaatataaactttcatccagttagcttcataacttttacgttccagaattttgtttattttcctgtcaatgaaagcaatttttaaagataccagtgggacagatttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcataacctt

SEQ ID NO: 13428 - DNA, 720 bp, Homo sapiens
gccataggaagtttccattgtggatgtgaacctgggtatcagctcaaaggcagaaaatgcatggatgtgaacgagtgtagacaaaatgtatgcagaccagatcagcactgtaagaacacccgtggtggctataagtgcattgatctttgtccaaatggaatgaccaaggcagaaaatggaacctgtattgatattgatgaatgtaaagatgggacccatcagtgcagatataaccagatatgtgagaatacaagaggcagctatcgttgtgtatgcccaagaggttatcggtctcaaggagttggaagaccctgcatggatattgatgaatgtgaaaatacagatgcctgccagcatgagtgtaagaatacctttggaagttatcagtgcatctgcccacctggctatcaactcacacacaatggaaagacatgccaagatatcgatgaatgtctggagcagaatgtgcactgtggacccaatcgcatgtgcttcaacatgagaggaagctaccagtgcatcgatacaccctgtccacccaactaccaacgggatcctgtttcagggttctgcctcaagaactgtccacccaatgatttggaatgtgccttgagcccatatgccttggaatacaaactcgtctccctcccatttggaatagccaccaatcaagatttaatccggctggttgcatacacacaggatggagtgatgcatccc

SEQ ID NO: 13429 - DNA, 2186 bp, Homo sapiens
agacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgctt

SEQ ID NO: 13430 - DNA, 2290 bp, Homo sapiens
cggcagacatatgacagaagactgaacaaccagaagttatgaagataggtactgtgggtgttagaaagattcacggcaaaacagggaaggcaagggcgattatggggactacagtgagccaagcctcccaccggatcatactgtggagacagaaaagtgaatcaggagctgtatctgctctctaaggcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgcttaa

SEQ ID NO: 13431 - DNA, 577 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggca

SEQ ID NO: 13432 - DNA, 605 bp, Homo sapiens
cataaaccctggcgcgctcgcgggccggcactcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagca

SEQ ID NO: 13433 - DNA, 605 bp, Homo sapiens; identical to SEQ ID NO: 13432

SEQ ID NO: 13434 - DNA, 754 bp, Homo sapiens
cggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 13435 - DNA, 502 bp, Homo sapiens
ttggaaaagcaacccctgccttgaagccaggatgatggtatctgcagcagttgccaacacaagagaaggatccatagttcatcatttaaaaaagaaaacaaaatagaaaaaggaaaactatttctgagcataagaagttgtaggaaggttttaatccaaataaggagaagatatgcttagaaccgaggtagagttttcatccattctgtcctcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtga

SEQ ID NO: 13436 - DNA, 486 bp, Homo sapiens
acactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgtgtaagaaggttcctgaggctctacagatagggagcacttgtttattttacaaagagtacatgggaaaagagaaaagcaagggaaccgtacaaggcattaatgggtgacacttctacc

SEQ ID NO: 13437 - DNA, 785 bp, Homo sapiens
atgacagaacagccaatctcagggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgcctatcagaaggtggtggctggtgtggctaatgccctggctcacaagtaccattgagatcctggactgtttcctgataaccataagaagaccctatttccctagattctattttctgaacttgggaacacaatgcctacttcaagggtatggcttctgcctaataaagaatgttcagctcaa

SEQ ID NO: 13438 - DNA, 566 bp, Homo sapiens
attgtggcattatttgaattcagaaaagagtgaaaaactactgggatcttcattcctgggtctaattccacatttttttttaagaacacatctgtaaaaatgttctgtactagcatattcccaggaacttcgttaaatttaatctggctgaatatgggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttca

SEQ ID NO: 13439 - DNA, 827 bp, Homo sapiens
agatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagt

SEQ ID NO: 13440 - DNA, 906 bp, Homo sapiens
gccatggttgtgaggcctccccagctatgtggaactagacttcaagaagttaagcaacttgctcaagatcatctaagaaatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagtaa

SEQ ID NO: 13441 - DNA, 578 bp, Homo sapiens
cttgcttctcctggccatggttgtgaggcctccccagctatgtggaactatagatgaggagccaacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaa

SEQ ID NO: 13442 - DNA, 808 bp, Homo sapiens
gaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgt

SEQ ID NO: 13443 - DNA, 602 bp, Homo sapiens
ataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgc

SEQ ID NO: 13444 - DNA, 560 bp, Homo sapiens
ataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggactggagtggccagtgccctgtcctccagataccactgagctcactgcccatgatgcagagctttcaaggatag

SEQ ID NO: 13445 - DNA, 694 bp, Homo sapiens
ggccatggttgtgaggcctccccagctatgtggaactgtaagtccggtaaacctctttcttttataaattgcccagtctcgggtatatcttcattagcagcgtgaaaacggacaaatacagcttcagtttcccctcactccactccccattaggggatagtttttgtccagattaaagaaaaacctattgtttatggtggtgctaggggaaatgaagaggaaagtcttgcctctccattttcttccgttcatgaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcaca

SEQ ID NO: 13446 - DNA, 1772 bp, Homo sapiens
gaatgtatccagagaatcaacatacaatgagcaaaagtgaagcttttcctagacttgaccctcatcaaatctcctctgtccccactctcttctgaagaaggaaaggctggagtacaatggcgagatcttggctcactgcaacctccacctcctgggttcaactgattctcctgcctcagcctcccgagtagctgggactacaggcatccgccaccacacccggctaatttttgcatttttttagtagagacacagtttcaccacattggccaggctggtcttgaactcctgatctctggtgatcttcctgccttgtcctccctaagtgctgggattacaagcgtgaaccaccgcgcctggtctgatgaatacatgtaaagcttattgagcctcagaactctaactacagggtttcaatagcacagaaactctgagaagaaaaagaatgtcaaagttcctccctaaggagactgattagatgcaagtgtgtccggaattggtgggttcttggtctgacttcaagaatgaagccgcggaccctcacggtgagtattacagttcttgaagactgcgtgtccagagtttgttccttctgatgttcagatgtgtttggagttttttccttctggtgggttcgtggtctcgctagctcaggagtgaagctgcataccttcgcgtcctaggacagaatatggatgctgaaaaatgattctttcaaagtgctgagttgttgcctcacgcccagttgtctggcatctcttcactgaaactattacagttagatctcatctctatgggtggaaggcctcactggagctacagacaagaaggtgaaaaacggctgacaaaagaagtcctggtatcttctatggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcaca

SEQ ID NO: 13447 - DNA, 506 bp, Homo sapiens
agagcacgtcaggcggcgccatgctcagcgcccaggagcgcgcccaaatcgcgcaggtctgggacctgattgcgggccacgaggcgcaattcggggcggagctgctgctcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctg

SEQ ID NO: 13448 - DNA, 536 bp, Homo sapiens
ggggtcgcagggcgcggcgggttccagcgcggggatggcgctgtccgcggaggaccgggcgctggtgcgcgccctgtggaagaagctgggcagcaacgtcggcgtctacacgacagaggccctggaaaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagc

SEQ ID NO: 13449 - DNA, 755 bp, Homo sapiens
ggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaa

SEQ ID NO: 13450 - DNA, 1652 bp, Homo sapiens
cattcccagtagagttggaggtgggggtggtgctgctgccaactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactgaggggccttctgacatgagtctggcctggccccacctcctagttcctcataataaagacagattgcttcttcgcttctcactgaggggccttctgacatgagtctggcctggccccacctccccagtttctcataataaagacagattgcttcttcacttgaa

SEQ ID NO: 13451 - DNA, 826 bp, Homo sapiens
aactctatatagggagttcaactggtcacccagagctgtcctgtggcctctgcagctcagcatggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtatatgcgctgtagcccacatctag

SEQ ID NO: 13452 - DNA, 2122 bp, Homo sapiens
gaatagtcagtacctagaagccactcttctttgaaaaggattatcacctgatcaggttctctctgcatttgcccctttagattgtgaaatgtggctcaaggtcttcacaactttcctttcctttgcaacaggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgctttta

SEQ ID NO: 13453 - DNA, 2148 bp, Homo sapiens
acctcactgctaatttccctagcaaataaaccagcagctgctggtccaagttaccactgagaacagggcactgcatgcatgggacaggatgctttcatggagcccttcggtgacacacttggggtctttcagtgcaaaatatacctccttctcttcggtgcttgctcggggctgaaggtgacagtgccatcacacactgtccatggcgtcagaggtcaggccctctacctacccgtccactatggcttccacactccagcatcagacatccagatcatatggctatttgagagaccccacacaatgcccaaatacttactgggctctgtgaataagtctgtggttcctgacttggaataccaacacaagttcaccatgatgccacccaatgcatctctgcttatcaacccactgcagttccctgatgaaggcaattacatcgtgaaggtcaacattcagggaaatggaactctatctgccagtcagaagatacaagtcacggttgatgatcctgtcacaaagccagtggtgcagattcatcctccctctggggctgtggagtatgtggggaacatgaccctgacatgccatgtggaagggggcactcggctagcttaccaatggctaaaaaatgggagacctgtccacaccagctccacctactccttttctccccaaaacaatacccttcatattgctccagtaaccaaggaagacattgggaattacagctgcctggtgaggaaccctgtcagtgaaatggaaagtgatatcattatgcccatcatatattatggaccttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggactggagaagcttgcacagaaaggaaaatcattgtcacctttagcaagtataactggaatatcactatttttgattatatccatgtgtcttctcttcctatggaaaaaatatcaaccctacaaagttataaaacagaaactagaaggcaggccagaaacagaatacaggaaagctcaaacattttcaggccatgaagatgctctggatgacttcggaatatatgaatttgttgcttttccagatgtttctggtgtttccaggatcccaagcaggtctgttccagcctctgattgtgtatcggggcaagatttgcacagtacagtgtatgaagttattcagcacatccctgcccagcagcaagaccatccagagtgaactttcatgggctaaacagtacattcgagtgaaattctgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgctttta

SEQ ID NO: 13454 - DNA, 2314 bp, Homo sapiens
gccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaa

SEQ ID NO: 13455 - DNA, 2724 bp, Homo sapiens
gccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaatgctgggcttttctctgtaagctggttctgcagcacaattcattaattaaacttctcccagtgcaagaaggcagctggtgctgggggtggtctggggggtcagggaggagggcaaggactacatggggcagaggcaaggcggtggtggagatgaggaaagaagttcttcttggcagaagctggggcagaaagatcacatgagatctgtggggacaccctctatctgaaacataagtctgtgttcattctctgcttagaaattttagatctgaagtgctacactgaaggtccgaaggttgatggggcatcagatatctttttggttggccagcatgatattttgaaataactgtcaacagttagaaactgggagcattcatatgtaaaaaatatggattttcagcttcttctt

SEQ ID NO: 13456 - DNA, 2527 bp, Homo sapiens
cagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggctgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcacggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgctccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggatggataaccatataatttaaaaagaaaaaaaaaatcaaaatataatatatttttttaccaatcggtagagaagagacagtttaatatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttttgatcattaaaataaaaaaataaatcttg

SEQ ID NO: 13457 - DNA, 5367 bp, Homo sapiens
agttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccgggacctgatgcccagaaccctggacgggcagatcaccatggagaagacgcccagttacttcgtcacgcgggaggcccctgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatgtatgtaaaatgtacagaaatctattttataataatttatttttaattcataagcaattaattcactaagctgcctagccacactctttagagagttagcttcataatctgttaacattccaaagtgtttaactctagtatttcgttctcttcttcacaattgatggtgcttctattttttcttctcccctacctgttatatttaaaacaaagaaaagcacaacttgagatttttgttgttacgggtattcagccttcagtcaccgtctgagttctccagttgctgcctccttgtcttgtcttgggtctcccattccagcttccctgtctcttcctgcctgtgtacctcgtaggaacgctgagctgcctcaacagggctgtattctgaagggcaggcctcatgcagcagcctccttgcagatgtggtgtcccgtccaatgatgtagcctgaaagccacagccctagggttctgtccctccctccattcagcacatggggaaatttctcactccctttacagggacatccacatcctttttttttcttttttttttttttttttttttgagatggagtcttgctcttgttgcccaggctggggcgtaatggtgtgatatatgcttaccacaacctctggctcccggttcaagcgattctcctgtctcagcctcccaagtatctgggattacaggcatgcaccaccatgcctggctaattttgtatttttagtagagacggggtttcttcatgttggtcaggctggtatcaaactcccgacctcaggtgatccgcctgccttggcctccaaagtgttgggattataggcgtgagccactgcgcccgctatccacatccttctagagtcagaatggtagggtctgttgacttcagcttttgattttgcaggatggccctgtgtcctcctctgccccattccctggttcattaaccagtttgaagtgtatgtagattgttgccccgtctttcccaggtcacatgtgtgagatgcctgggtgctgcttcagaaatcaagatgatctcctttaatttgcatgaaactacaccatgctgcgttccccaggcagacagttctgctttgacacaccaaagaatcccgtaggctagcagagccaccagcacaaaccaagggcgctgggtgtcgagactcagaggggtcagctgtgtccctcggcatcagcgtctaccaaggtgctgctaggtacagagccagccagtgttgggcagcaggctcacagcctcaatagggagaaaagacaaaggcctcaaaatgacaggcagcctgacagaggaaggagtctgacacctcagcttgatgcgtctttggaattcctagctcatctcagaattatatcttagagtgataatatgggtggtagccagtggccaaacagcaagaactaagagtggcccttgcaaaaaaaggttgggaaagctgggcccatattgcctgtaaacccttgagcctgatgctcatacagctgtcccttgttttagccaggtcttgacagaagggttaccagcactgtcactgctctacagaatgctctccccgtgcctctctgttgatttataacagttgggtaaccagatagcaatatagtggcaattgagtagccatatagtaatacaggggcagttggttaaacatatagcaatatcacataatgatatgtttaatttaacctcagttttttaaaccagaatgcttctaccataaaagaattgtgatttcagttatacttccatcaaggaatatgtgggaagatatacatattgtcaaaatggttgggatgggatagttacaaaggacacttttgtatgttgtatgggatcacttgcctgatagtataaggaacattgtatgaaaagatgaaaagatacttcatttttagaaactgatcagagatgtcactggtctttaagtgatgtcttgaaaatccagtatgtatttgcccaaaagttttagcctacatctagctagcttacacttagcagccaaaccatcattgtgtaggttctgttttggaggaagctcatgggggatctgtgtatttcttaggtttctccctgttctccaatgttttatccatttcgtagcttttttactgtctccagaaagtagtgtgggacctgcacttaggggaataccagaatcatagcgtggttctgccttcttgatgagtgattgtgaaaaacacctgcataagggtgctaattggttgtgtattttttcatttatttgaaatcaaactgagaacacctcttttcggtttacagcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttagatgttttctcacttttgtgacattaatttatcactgagtctcattcaaccaagtaatctaaaatactgtgcaaattctagcagtatgtcttcgataacttggatgttaggatagccaatatgtacaaaaaattaaatcaagtattttgtcctatgtataacacaaattaattttacacagagaaagatgtttctaggcaagtgaaattctggtaattcatactatttctttgtatgaacaaataaaatatattttgccaa

SEQ ID NO: 13458 - DNA, 2808 bp, Homo sapiens
agttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccgggacctgatgcccagaaccctggacgggcagatcaccatggagaagacgcccagttacttcgtcacgcgggaggcccctgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttag

SEQ ID NO: 13459 - DNA, 3203 bp, Homo sapiens
cagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgccgagcggcggcggaggcgcccaggacgcctggctccggaccccgctggcccccagcgagatgatcacggctcagagcgcgctgccggagagggaagcgcaggagtccagcaccaccgacgaggatctcgcaggccggagagcggccaacgggagcagcgagaggggcggcgccgtcagcacccccgactatggggagaagaagctgccacaggcgctcatcatcggggtcaagaaaggagggacccgcgcgctgctggaggcgatccgcgtgcacccggacgtgcgggcggtgggcgtagagccgcacttcttcgacaggaactacgaaaaggggttggagtggtacagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactggtcaagattttcagtgggaacaggaagagggtgataaatgaggctagagaggcagaggaaggctagtcaataagctaaggaggctccttgcctgagtccttgaataccccagcttctgcagcttcacttgctggagtgccaagtagatctcctcctccttcatgcagccaggattgcctccagtgctgttagcttaggcaaacaggtggatcccatggcatccccatggaggaaccaggcccatctgggcagcagcatctggttgaccagatggccaccagaacccactgttcattcttatcttctgctagttaatatagcctgaagacagaggataaatagttgtcaatgtcagagacagtgctattaatgtatatgtgagcgacaaaaaaggtctgctttataggggttctcactctagcttggggagccagggttctagccctgtatctgtcatgggcacctgctgtctaaacctctgcttgggcttctccccagaatgcactttgtggctgagtgctccaggactcctagggagcaaggtcctccctctaaggtgtttctagtcttctctttaaaggtctcatcccacaacccctgacttcctccctccccacatcatgaaggcagaggcatgcacattcctcactgaaaaagaaaacacacacccacccacacacacacacacagaagaaaatgaaagctgacacacctcgaagccttctttccaagagccctctaaatggggttgggtctcactcttcatgagtatcctgggttgtgcagaagcttagcatatgcccttgtgttcggatcaggcccacagggctgctcaaagagtagagtaattgtaaccgaggtcagagctctggggttggcagagatgagtggccatatctgggggtaaaagaagaaatcctgtcctcttggtgggaggttaccttacctgaagaccatctctcccaagcactgtagttctgagcatgtttttggggtggactctgtcccctagggtccctagaagggcaaagaccagagagttgacaagtctgttattaggaataatccttagccatgtaatggagaaaggagcagtcagcattcttccaatttgccccaccaccacctcctcgggcttcattttctctatttagagatggcagagagtgaggtagtggcgagaaagctgactccattcatcagatccagtttatgagggttgggggtgagcaagggctgtctgcagaaacccccatcaagagctgctgaatgaagtgtcccttcccatcagtttgattcaattaaaatgcatcatttgacataaagcacttgttcacagatctccaaaaccaggaattgttctagtaaaactggaaatttgtatgagtggggggagttaaatctgttcagctgttattaaactgtcatttctcccgctaaatgaaaaccgtgttgttataaagcttaatgcaacctgatta

SEQ ID NO: 13460 - DNA, 3901 bp, Homo sapiens
gggagggtgtggactggcagccactctgcagctggtcgccagggacccggtccctcctgcgcgcccaagtgatggaggggaagagattcgcttagacacacacacgcgcacacagctgggcacgtctccgggaggcagctgccggctcgggcgctctgggggccgggcggcggccgtgacagcgccagccgcggggagcggggcgcccgcacagcttggcaccggaggctcgaggacgcaggaagggaagatcccagtcacactgagtgttgctcttttgggcggattgggagggagcgggctgcccgaggagctgtcaccgaggacgcccgaagtctcgccctctgcgcgcagggtccggggctgcgccggtgccctcgtggggcaaggaggatgcgcacctccccccgcagagcggctgcggtctccggcactgcgcggactccggctcctgcggccgcccgtgccgtgcccgcgccacgggagcgcgccctgccgcacctggttccagcctctcggggaagtgcaggaaacgcgccctaaactccactacttctcgcccgcctgcccccccgcccggctccccgcctcagacctcgccgccgccgccgccgccgccgccgcctgcgtgtggggcccgctcgcgtcttactcacacgcgccacgcacagccctgttggtttgctctcattcacgccgactcgctctccgccgagcctagcccgggcatccgaaactactggaccaactgccgtccggaccgcagcagcggccgggtgacccccacgcgacccgccgccgacccccgcgccctgaggctcccgcccgcgccgccaccgccggggaccacgagataatcagatactcactgtcttcagcattggtgtcttctattctcaacggcatttctggtggccaccccaggagtctccctgacctgttttaaaacccttggaaattaaggagagaatccactacatatattcctttgaaagtttccaccatatatgttcaaaaattgctgaatgagcacaaggatttgaaggtgctaaagcaagggataaaccaaaaggacagccagtaggtgaggagaggccatggaatacccgccaacaagataatcatcgctggaataatagggacctgtctgaatgtaggctgcagcagtcctgaaggttgatggagggccatgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaaaataatatgtcatacaacactatgtgttgtgcctggagacacacaatgtctcctgtagattaaaatatgcacttttcctaggcagagctatccaagtcatttttccatgtatatttgtacatacgcagtgtgtgaccaaatataagatcagttctttttctactgaaaatttacgaaaaaaaaaaaattgctgtctgcatagtcgcatcttttaagctatttacaaaagagaagaggtggtggtattgggggaaagtgacttcagctattctcaaagagttagtcttcctttgattcagaatttgtcacccgccattttcatagatttaagccaaaagataaatgtgtgaaaatgtaccaatggctgcgaagcttcaggaagtagaggatccagtgatgcattttttttttcctaagggaaagctggctctttaattcagatgctgaattggtgccatgaaaacagaaaatgctattttcttattatttaaaagaacgtcttatctcataaaattgacattgttccaaagttcttgtggtgattttgcactattgttttctcgtatggaccatggtgtcacttgtagcatgtcaatcacacattggaaagtcaagtccttttacttccatgttgtatgtcaacagagagaaatgtcatgtacataatgtatattgttgtaaatactggtttcacactaagtaattctattttgtaaactgaatatggctatttaatttattgtgaaaattaaatttattgtggtatttaaaaatggaatggattaaaattactctatgtgcaattttttttttttttactcattttgttttacgtgccccctgctggcttccaaaatggaagctgtttacgtgcatatgagagcacttggaaagatgtgcttccctgctggatttctgtaccccagtgaaaatgtatttatgaagtgaggttgagtatattaaaaaagaaaaacctcaaccatctggaaatcaagtataatagccacctcaaagaaccctagtgctgctctgctacaactttgtaacaattaatttactcgcagttgctgctgctcaggaagagagacaaggaatattttaacagaatcaaggcatagaagaatcaccattttatttgaacctctaatcagagtcagaccagtagagaaattaaataagattagaaaactctgtactgaaagctgctgatgcttcaaaaatgaaaacaagatctcacaactctccctgttagttgaaaatatatcaatttgctctgaaaggattcagctgcctagtgttgccattactaacataaacatatggctcatatttccatccagagaaattaatgctaaattggtgcctcgctaacatcagatacactgtattatgcttaaatatattcagtaaaatgtggaaaggggtattaacaacgacaacaaaaagatggattttttttttctcacaatcacagttgctaatccagtgggagatgtttgagagagttttgttcaacatcacagtgagagtgcctagggaaatcagaaaattacaatggattcccctttgattgtaataagtgttgattttctccatgagttgtttatcctgtctagtgatttgatggtgaacttttctaaataaatagccctttcccctccggtgtcggta

SEQ ID NO: 13461 - DNA, 2744 bp, Homo sapiens
gctgcagcagtcctgaaggttgatggagggccatgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaaaataatatgtcatacaacactatgtgttgtgcctggagacacacaatgtctcctgtagattaaaatatgcacttttcctaggcagagctatccaagtcatttttccatgtatatttgtacatacgcagtgtgtgaccaaatataagatcagttctttttctactgaaaatttacgaaaaaaaaaaaattgctgtctgcatagtcgcatcttttaagctatttacaaaagagaagaggtggtggtattgggggaaagtgacttcagctattctcaaagagttagtcttcctttgattcagaatttgtcacccgccattttcatagatttaagccaaaagataaatgtgtgaaaatgtaccaatggctgcgaagcttcaggaagtagaggatccagtgatgcattttttttttcctaagggaaagctggctctttaattcagatgctgaattggtgccatgaaaacagaaaatgctattttcttattatttaaaagaacgtcttatctcataaaattgacattgttccaaagttcttgtggtgattttgcactattgttttctcgtatggaccatggtgtcacttgtagcatgtcaatcacacattggaaagtcaagtccttttacttccatgttgtatgtcaacagagagaaatgtcatgtacataatgtatattgttgtaaatactggtttcacactaagtaattctattttgtaaactgaatatggctatttaatttattgtgaaaattaaatttattgtggtatttaaaaatggaatggattaaaattactctatgtgcaattttttttttttttactcattttgttttacgtgccccctgctggcttccaaaatggaagctgtttacgtgcatatgagagcacttggaaagatgtgcttccctgctggatttctgtaccccagtgaaaatgtatttatgaagtgaggttgagtatattaaaaaagaaaaacctcaaccatctggaaatcaagtataatagccacctcaaagaaccctagtgctgctctgctacaactttgtaacaattaatttactcgcagttgctgctgctcaggaagagagacaaggaatattttaacagaatcaaggcatagaagaatcaccattttatttgaacctctaatcagagtcagaccagtagagaaattaaataagattagaaaactctgtactgaaagctgctgatgcttcaaaaatgaaaacaagatctcacaactctccctgttagttgaaaatatatcaatttgctctgaaaggattcagctgcctagtgttgccattactaacataaacatatggctcatatttccatccagagaaattaatgctaaattggtgcctcgctaacatcagatacactgtattatgcttaaatatattcagtaaaatgtggaaaggggtattaacaacgacaacaaaaagatggattttttttttctcacaatcacagttgctaatccagtgggagatgtttgagagagttttgttcaacatcacagtgagagtgcctagggaaatcagaaaattacaatggattcccctttgattgtaataagtgttgattttctccatgagttgtttatcctgtctagtgatttgatggtgaacttttctaaataaatagccctttcccctccggtgtcggta

SEQ ID NO: 13462 - DNA, 3558 bp, Homo sapiens
atgctgtttatcaaattcattcatctcgaagtattcagtatgccagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacagcaccagatactgctacaccatctcatcggcatggacctatatgtggcagcaagtccatctcatcgcttttggtgaaagtcagtccagtttgtaaagattctcattgtcactgtagacgaggaactgggacaccaaaaggagaaactctggccacgcttgcaccctgttcccaatcctggtccagtgtcacccacagatggtaaggagctctagagacctcaccagcccctgggattggtcacctcactcttctatggacagagattcctgctgggatcctttgagggcaagcagacccttcttccagctcggactgtgaactccactgcagccgtaaggactgtctgtgacagtgagcccgagatgactgggctctgtgctccctcccggccctccaatccttggcctgccacagagaactgagctcttttattagcaccatgaatgtgactgatacagctagccattcccttgtgcgaatgactcagtttattaatgctctgctaaagatggcttctttgcttgccagcagccttaaacagtatttcattaaaactggcttaattattttgagaagacggcccaattaaaagctatacactccctctatgtgagtgtttatacatagagctgtatatataatacatatttgtaagtgtgtatatatatatgtgtgtatgtatgtgtctataaatatataggcttagcaatttcattacatgggataaattgttggaaaaaatacccaggagctggtcccctttctgttgctagattcagagtagaggccacccctccactctgggagaggctggtgttggtgatctctcaatgactctgcaatggaagtcccaactgcacagagccctgccccagtttcaggagccagcagcctcggagaggcggatcctgacctctgctctgctcttgggatagcctttcccttcccagcagggttgagatacttgggccgggaaatgttgtggcaaagtgtttgccaaagctcaggagagacacagacttggggcttttgtttcttgagctggctgtctagctttcctaatgagcaaatatgttctctttaaggaaacaaacaaacaaagcaaaaacaccaattcatctggattttattcatttgttttaaatacaaacaaacaaaaggagagtggttatttctgcaccaactatttcaaatgcaagttactccatcgctcggggtggttggatggtgcttgtcaccataggacccacagggctagttccaactgttattcggtaaggcttttttctttccaaaattcccagtgttcctttaaggcccatttagctgcgggttttgtttattctcccggcaatcagcatttaaaataagacaaacaagcattttttcctgggctgtgaatccccccggccagcctccacctgcacacctgaagccagcatgtccaatcaaatttctctgtaacccatatcccctttagagacttgcccccgtcgtataccaggctggaaatagagaacttaagcagggcaaatgtaattttaagaattgctaatgatgctagaaatctgcaatgcaattagcgtcattggatttggcgctcctccgaaggcacaaaactccttgtcatagcgcagtggcagcagcggcaagtgcctccgcatgtgccgggctgtccgggtatgctggcagccgctttgcactgagatgtgagcagttggttaggcttcctctctttctttctcacagatactgacttctttgtctcttttctgggttgcagagggatgggtattttccattgattattactttagcatttgaccctccagtggagtcaccctgttttttttttagaaaactgagactctcactttgtgaattcactgtgctctctgggatttcagtgctgtagttcaaccaccaatccccctgtcctgaactccagtacttctgatgctattaattggttcctcaacaattgtggccttttccatcattgcccaccatagtatatactttttctttctctctcttttttctaatttccttgtcttcttcactctccatggagccagaggtagtatgaagagttaaaaataggaatataaagaaagccagagggacagagggagtgagaaagaaaaattttaaaaagggaggaaatgaattattggattaaaaataaacttttacttttttgcagaaaaattatttttgctctctgggaaaataacatgggccaggcataaaaagcatgtcagctggctaaaagattgcaaaatccagaagatgatctcgatgtgtctgttcaatttagcaagggtatctactaggggatcctcttttaaatatggaggcccaaatcagaagcttgtagaggggagctattcttccaagattccagatgtgtctgtgagacaacacgttatggggcaaattgatttcacccttgggaaaccagggagattttcaaagttatgtctgcaaagccagctaatgcaattccccattagtgcattaaagtgcgcccttattaattcaaacataaaggcaacaaaataagcttttaaatttaaaatataatacatatataatgagcatgtgtgaaagccttattcaaatgaaaatacaggagtgtttgaactactgaggtatcttttgtattgaattatgagcatatgtaatagatttaattattaatttccccattgttctatgcacacagacagggttcaaggcacagtcattctctggctttcatagatctaatttgtataattattgcctg

SEQ ID NO: 13463 - DNA, 2013 bp, Homo sapiens
tgtggggagggtacctctcacagaagagtcttatgactggcatcaggggaaggtcaccaagtctttcctgtacatgctgtttatcaaattcattcatctcgaagtattcagtatgccagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacagcaccagatactgctacaccatctcatcggcatggacctatatgtggcagcaagtccatctcatcgcttttggtgaaagtcagtccagtttgtaaagattctcattgccttggaaagtgttccaggaatggactttctgcagtatgatgacctgcaaaagcagcccttccatttacatttcaaactccaagtcagccgtgtcaaagtttgaaccagaactgtggaggataatgggtcagatgcaattagcagcccagagaaccacacgttgcagtctgatttatttttttgcccatcagattccaagaatcctagtgcttaaaagcaactaaacaatcgctctattgtactgaaataaagcccggttaattcagaaatcaattgcaccaccaggtggggcacactctggccccaaacagatggggttgaaaactcccctcaaaatgcagtcttgttaaattaaaaacttgatccaggagtggaacaaatagggagccatgaatggaatggagtcaggtccactcaggcggattctttcttctcccactccttttcctttaaaaaagaaaaattccccatttcactttcatcagtgttagcatctatgcagaaacgcagccatccaccctttgcagttgaatgtgttactttaattagtctgaaaattaaagggcaactccgggccaatgtgaatgattatgaaaatacatgtgcatcccatgcaatcttctcatttaattaatagtcttgtaaactatatggctcactttaagtcagtcaagaggtataacaactccattttaaatatccacttaatacttaacaggatgtgaggaacacactatagcatacggtcccttctcaagtttcactgtctgaaatttttcaaagctgacccaagtcaacctgaaaaatgtttaacaccctgggcttgaacacaagaaactctgtgatgaacagacattcaattacattttttaaaagtgagaagcatttttgtaaaatagcgactctggaaactaattggcagccgcaaaacttgtgagcaaaggccaaatcttgtggggaacttttactacagtaacacgactcaaagaaaatgtgaataaaaggcatctttgtttcccagtcaaattagctgattaagaaataaaacatcttaacatgtttttaaa

SEQ ID NO: 13464 - DNA, 6731 bp, Homo sapiens
agggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggaaagaaatctcatcttaggaaaaccacagagaagaaactccccactaaacaaaccattgcaaaactacagcaatctgatatttggaaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattggattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggccaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatctgtgtaaatcatctaactggatttttccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactactctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgta

SEQ ID NO: 13465 - DNA, 1566 bp, Homo sapiens
cggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtgcgctttgtaaagaatataacttcctggaaagagatgaaaccaggattttatcatggacacgtttcttacttggattttgcaaaatttggtgtgaagaagaaaccaatttacattaatgtcataagggatcctattgagaggctagtttcttattattactttctgagatttggagatgattatagaccagggttacggagacgaaaacaaggagacaaaaagacctttgatgaatgtgtagcagaaggtggctcagactgtgctccagagaagctctggcttcaaatcccgttcttctgtggccatagctccgaatgctggtaggggagataaagttggctcagattgattatcatccttattatctctgtaatctgtgtttcatttcacaagggctagatatagggaaatcggtgaaagactagactaaaaataacatgtaattcagtaatatctagttttgcagttacttttaaatgcatttaaaagattcctcatgtagagtgatatcctaatatccttgcattgttttctgagatgccggtttttagtatttcttatttttggtgttatgttttgctgtattccagcagagctcttagagactgggggtgggggtgggtgtcataaatcttattttgtccaaagcttactgttttagctattcatgttaaattaagaaaaggcttagtgggttaaaattcacctggttttactgttaaactgattttgactttaagagaagccaaggttatggctgtggtttagtttgctagtaaatatcaagtggaaaataaagatactttaataa

SEQ ID NO: 13466 - DNA, 3932 bp, Homo sapiens
ggcgatggtgacacatgcggcggcggcgcgccggcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctggacctgttccccacacccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtcgttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttagctcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccaaggaggggtttgggtagtaggcccgagctgcattgccggccttcctcgggccaactggcagcccaggagtggggaggctttggccagggatgctgccacttgtgcgtgagtccgcggctggcccttggaggtgaccatccaggcaggcctggctcagactggaagggctggggaccgagggctcccctgcctctgttctcctttctgacccactgggatttgctagcaggctgccccagccccatcaccgaaacacatactcaagagctcaaataccactgctcccaccagcgtacggattaagttcatcaggcttccatcggctggagcatgggaccatagcccctgcccaggagccgtaccctcggaccacagtggctctgtatggccaggaactgggactcgagctttcagattctcaactagccttggcaaaacagctgtaggtggcctccctgacaacagacactcagccctccccaccctggctctccttgcatttccccatgctccccaccccctggcaaaaggctggccatgctctgttcccagcagccgcgcaggtttccccactggctgcaatggccctaccaaaagccatgttgcatatccgttgtaagcacgtgccctgtgccctgtccccattccttatgccctaggaggccaagctggtgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctggaggtctggcataagggccccaccctcaggtctcctacactggccccattttactttggggtccaaggacaggatggtcaacagggcagggtggacagcgtgccagcgccgcgcagggccacctccctgggtggatgcatcacactaaggaagtgagtgccaaggggatttagtggtgtggttctttcaaagggaggtcagggtcaatgggaatctgctcggacactcaacatgggggtgggtgcactccttggaggaggaggaacacgttcaggggattgtgaggtcttgcacaagccacgtggggcaccttggcttcccggcaggaggtggacacccagccagaggcctggctcaaggtgacctcaccttcaccatgggcttcctgggtgcgcgggcctgagcgcaggttgttttgtacatattggaatatgtgttaacttatgccccgcatcccaactcacacggaagcacgggtcttgtctcagtctcttcgctgcatttggaaagcagtctcctctcgggccagcgccgggctgaggtgtccagaggcggcggcagctggcagtgccctcagcccccaagtgtccagcctggcacttcccattcaggccacctgctttgggtcaacagttcctttgccagcagcatctcctaaattgtaaggactctgtccaccggggccctcccagggctgtgaggacggaaacaggcagggagtggagctaacagcttagtcaccaggacccccagacctgcaaacgtcccctcctggaaggggaagccaggaacagcagaactgcccacaaaacaaggctgtgaacttttcgggaactggaactgtttaacttgaacccaggattgtttaaagctttatttatttatagcttcttcttaaaaaaaagtgttgaagaaattttttggttattcatacaaaaaaatgagttgatgatggaaaagcaagtcataatcatctaattgtttttgtctaggtcgagaatgaatgttagctgatgaaataaaccctgacaagga

SEQ ID NO: 13467 - DNA, 831 bp, Homo sapiens
atgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgctgcgcatgctctccgacctga

SEQ ID NO: 13468 - DNA, 1389 bp, Homo sapiens
atggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagcaaggagcagaatgataacaccagcaatggcaccaacgactacataggcagtgtagagaaatggcgttaa

SEQ ID NO: 13469 - DNA, 4441 bp, Homo sapiens
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattac

SEQ ID NO: 13470 - DNA, 3607 bp, Homo sapiens
ccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggctc

SEQ ID NO: 13471 - DNA, 1246 bp, Homo sapiens
atctatgagctgtttccctaaggtttgggaagctggagaaatatgctcttaaagcacaatggaaaacttttattattttatctcctctcctaccaagctcttgctagcgactggttttactgttcctttaacaggtggaggatttttcagattctagatgcagcaaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtct

SEQ ID NO: 13472 - DNA, 2607 bp, Homo sapiens
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacacccggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagact

SEQ ID NO: 13473 - DNA, 1659 bp, Homo sapiens
gcctgccggcctgagagcgggaccatggatgaaaggttcaacaagtggctgctgacgccggtgctcactctcctcttcgtggtcatcatgtaccagtacgtgtccccctcctgcaccagctcctgcaccaacttcggggagcagccccgcgcgggggaggccggcccgcccgccgtcccgggtcccgcccgccgggctcaggcgccgccggaggagtgggagcggcggccccagttgcccccgccgccccgggggccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggaatttctattacatcacaatgttacgggatccagtgtcacgttacctgagcgagtggaaacatgtccagagaggggccacttggaaaacctctcttcatatgtgtgatggaagaagccccaccccagatgagctgcctacctgctaccctggggatgactggtctggggtcagcttgcgggagtttatggattgcacctacaacctggctaacaatcgccaggtgcgcatgctggctgacctcagcctggtgggctgctataacttgactttcatgaacgagagtgaaagaaacaccatcctgttgcagagtgcaaagaacaacctgaagaacatggccttctttgggctcactgagttccagaggaagacacagtttctctttgagagaacattcaacctcaagttcatctcccccttcacacagttcaacatcacgcgggcttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgcagaagggactgtcaccgaggactacaacagccaggtggtgagatggtgacctcctgccctctcctctctcaggagggggagggtgagcaggcacattgactttctgttgaggtaccttggagaagctgagccattctgaggacatctggctgtgtgtgcttgatttggacatcttcttccttctttgtcttcatttttatccagctggagattatccgtcttgttcttttttttcttgacattttgcaattggtgatattaagtaggg

SEQ ID NO: 13474 - DNA, 538 bp, Homo sapiens
cagcacagacccccccacccccgccggccgctgtggcggtcgcagtgacaccagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccg

SEQ ID NO: 13475 - DNA, 411 bp, Homo sapiens
cgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaagaatccagaacttggaccagagctgccaagggacgtatatatgccaggcccatggaccttgggggaaggcccaggccagtgcccagctggttatccaaggtaggagggtggcttcaggcctctgctaagagcagggaacagagatgagaaaggcagagaggcacaaggcccagaccctgttccctaggaatccccctaaatgtgtcagaataaagagaattattccattt

SEQ ID NO: 13476 - DNA, 14327 bp, Homo sapiens
ggccggcgagcgggcggctgcgggcggcgcggagcgggcggcgcggagcgagcgagcgagagagcggcgcgggccgggccatggggtggcgggcggcgggcgcgctgctgctggcgctgctgctgcacgggcggctgctggcggtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagttccgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaactgatgaagccaactgccccaccaagcgtcctgaggaagtgtgcgggcccacacagttccgatgcgtctctaccaacatgtgcatcccagccagcttccactgtgacgaggagagcgactgtcctgaccggagcgacgagtttggctgcatgcccccccaggtggtgacacctccccgggagtccatccaggcttcccggggccagacagtgaccttcacctgcgtggccattggcgtccccacccccatcatcaattggaggctcaactggggccacatcccctctcatcccagggtgacagtgaccagcgagggtggccgtggcacactgatcatccgtgatgtgaaggagtcagaccagggtgcctacacctgtgaggccatgaacgcccggggcatggtgtttggcattcctgacggtgtccttgagctcgtcccacaacgaggcccctgccctgacggccacttctacctggagcacagcgccgcctgcctgccctgcttctgctttggcatcaccagcgtgtgccagagcacccgccgcttccgggaccagatcaggctgcgctttgaccaacccgatgacttcaagggtgtgaatgtgacaatgcctgcgcagcccggcacgccacccctctcctccacgcagctgcagatcgacccatccctgcacgagttccagctagtcgacctgtcccgccgcttcctcgtccacgactccttctgggctctgcctgaacagttcctgggcaacaaggtggactcctatggcggctccctgcgttacaacgtgcgctacgagttggcccgtggcatgctggagccagtgcagcggccggacgtggtcctcatgggtgccgggtaccgcctcctctcccgaggccacacacccacccaacctggtgctctgaaccagcgccaggtccagttctctgaggagcactgggtccatgagtctggccggccggtgcagcgcgcggagctgctgcaggtgctgcagagcctggaggccgtgctcatccagaccgtgtacaacaccaagatggccagcgtgggacttagcgacatcgccatggataccaccgtcacccatgccaccagccatggccgtgcccacagtgtggaggagtgcagatgccccattggctattctggcttgtcctgcgagagctgtgatgcccacttcactcgggtgcctggtgggccctacctgggcacctgctctggttgcaattgcaatggccatgccagctcctgtgaccctgtgtatggccactgcctgaattgccagcacaacacggaggggccacagtgcaacaagtgcaaggctggcttctttggggacgccatgaaggccacggccacttcctgccggccctgcccttgcccatacatcgatgcctcccgcagattctcagacacttgcttcctggacacggatggccaagccacatgtgacgcctgtgccccaggctacactggccgccgctgtgagagctgtgcccccggatacgagggcaaccccatccagcccggcgggaagtgcaggcccgtcaaccaggagattgtgcgctgtgacgagcgtggcagcatggggacctccggggaggcctgccgctgtaagaacaatgtggtggggcgcttgtgcaatgaatgtgctgacggctctttccacctgagtacccgaaaccccgatggctgcctcaagtgcttctgcatgggtgtcagtcgccactgcaccagctcttcatggagccgtgcccagttgcatggggcctctgaggagcctggtcacttcagcctgaccaacgccgcaagcacccacaccaccaacgagggcatcttctcccccacgcccggggaactgggattctcctccttccacagactcttatctggaccctacttctggagcctcccttcacgcttcctgggggacaaggtgacctcctatggaggagagctgcgcttcacagtgacccagaggtcccagccgggctccacacccctgcacgggcagccgttggtggtgctgcaaggtaacaacatcatcctagagcaccatgtggcccaggagcccagccccggccagcccagcaccttcattgtgcctttccgggagcaagcatggcagcggcccgatgggcagccagccacacgggagcacctgctgatggcactggcaggcatcgacaccctcctgatccgagcatcctacgcccagcagcccgctgagagcagggtctctggcatcagcatggacgtggctgtgcccgaggaaaccggccaggaccccgcgctggaagtggaacagtgctcctgcccacccgggtaccgtgggccgtcctgccaggactgtgacacaggctacacacgcacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggcccaggtggaaggcctcacttgcagccactgccggccccaccacttccacctgagtgccagcaacccagacggctgcctgccctgcttctgtatgggcatcacccagcagtgcgccagctctgcctacacacgccacctgatctccacccactttgcccctggggacttccaaggctttgccctggtgaacccacagcgaaacagccgcctgacaggagaattcactgtggaacccgtgcccgagggtgcccagctctcttttggcaactttgcccaactcggccatgagtccttctactggcagctgccggagacataccagggagacaaggtggcggcctacggtgggaagttgcgatacaccctctcctacacagcaggcccacagggcagcccactctctgaccccgatgtgcagatcacgggcaacaacatcatgctagtggcctcccagccagcgctgcagggccctgagaggaggagctacgagatcatgttccgagaggaattctggcgccggcccgatgggcagccggccacacgcgagcacctcctgatggcactggccgacctggatgagctcctgatccgggccacgttctcctccgtgccgctggcggccagcatcagcgcagtcagcctggaggtcgcccagccggggccctcaaacagaccccgcgccctcgaggtggaggagtgccgctgcccgccaggctacatcggtctgtcctgccaggactgtgcccccggctacacgcgcaccgggagtgggctctacctcggccactgcgagctatgtgaatgcaatggccactcagacctgtgccacccagagactggggcctgctcgcaatgccagcacaacgccgcaggggagttctgcgagctttgtgcccctggctactacggagatgccacagccgggacgcctgaggactgccagccctgtgcctgcccactgaccaacccagagaacatgttttcccgcacctgtgagagcctgggagccggcgggtaccgctgcacggcctgcgaacccggctacactggccagtactgtgagcagtgtggcccaggttacgtgggtaaccccagtgtgcaagggggccagtgcctgccagagacaaaccaagccccactggtggtcgaggtccatcctgctcgaagcatagtgccccaaggtggctcccactccctgcggtgtcaggtcagtgggagcccaccccactacttctattggtcccgtgaggatgggcggcctgtgcccagcggcacccagcagcgacatcaaggctccgagctccacttccccagcgtccagccctcggatgctggggtctacatttgcacctgccgtaatctccaccaatccaataccagccgggcagagctgctggtcactgaggctccaagcaagcccatcacagtgactgtggaggagcagcggagccagagcgtgcgccccggagctgacgtcaccttcatctgcacagccaaaagcaagtccccagcctataccctggtgtggacccgcctgcacaacgggaaactgcccacccgagccatggatttcaatggcatcctgaccattcgcaacgtccagctgagtgatgcaggcacctacgtgtgcaccggctccaacatgtttgccatggaccagggcacagccactctacatgtgcaggcctcgggcaccttgtccgcccccgtggtctccatccatccgccacagctcacagtgcagcccgggcaactggcggagttccgctgcagcgccacagggagccccacgcccaccctcgagtggacagggggccccggcggccagctccctgcgaaggcacaaatccacggcggcatcctgcgcctgccagctgtcgagcccacggatcaggcccagtacttgtgccgagcccacagcagcgctgggcagcaggtggccagggctgtgctccacgtgcatgggggcggtgggcccagagtccaagtgagcccagagaggacccaggtccacgcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtctgtgctccacggcacccattctggccccagctacaccccagtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtgtgccgggtgatgggcagctctggccccctggaggcctcagtcctggtcaccatcgaagcctctggctcaagtgctgtccacgtccccgccccaggtggagccccacccatccgcatcgagccctcctcctcccgagtggcagaagggcagaccctggatctgaagtgcgtggtgcccgggcaggcccacgcccaggtcacgtggcacaagcgtggaggaaacctccctgcccggcaccaggtccacggcccactgctgaggctgaaccaggtgtccccggctgactctggcgagtactcgtgccaagtgaccggaagctcaggcaccctggaggcatctgtcctggtcacaattgagccctccagcccaggacccattcctgctccaggactggcccagcccatctacatcgaggcctcctcttcacacgtgactgaagggcagactctggatctgaactgtgtggtgcccgggcaggcccatgcccaggtcacgtggtacaagcgcgggggcagcctccccgcccggcaccagacccatggctcccagctgcggctccacctcgtctcccctgccgactcaggcgagtatgtgtgtcgtgcagccagcggcccaggccctgagcaagaagcctccttcacagtcaccgtcccgcccagtgaggggtcttcctaccgccttaggagcccggtcatctccatcgacccgcccagcagcaccgtgcagcagggccaggatgccagcttcaagtgcctcatccatgacggggcagcccccatcagcctcgagtggaagacccggaaccaggagctggaggacaacgtccacatcagtcccaatggctccatcatcaccatcgtgggcacccggcccagcaaccacggtacctaccgctgcgtggcctccaatgcctacggtgtggcccagagtgtggtgaacctcagtgtgcacgggccccctacagtgtccgtgctccccgagggccccgtgtgggtgaaagtgggaaaggctgtcaccctggagtgtgtcagtgccggggagccccgctcctctgctcgttggacccggatcagcagcacccctgccaagttggagcagcggacatatgggctcatggacagccacgcggtgctgcagatttcatcagctaaaccatcagatgcgggcacttatgtgtgccttgctcagaatgcactaggcacagcacagaagcaggtggaggtgatcgtggacacgggcgccatggccccaggggcccctcaggtccaagctgaagaagctgagctgactgtggaggctggacacacggccaccttgcgctgctcagccacaggcagccccgcgcccaccatccactggtccaagctgcgttccccactgccctggcagcaccggctggaaggtgacacactcatcataccccgggtagcccagcaggactcgggccagtacatctgcaatgccactagccctgctgggcacgctgaggccaccatcatcctgcacgtggagagcccaccatatgccaccacggtcccagagcacgcttcggtgcaggcaggggagacggtgcagctccagtgcctggctcacgggacacccccactcaccttccagtggagccgcgtgggcagcagccttcctgggagggcgaccgccaggaacgagctgctgcactttgagcgtgcagcccctgaggactcaggccgctaccgctgccgggtcaccaacaaggtgggctcagccgaggcctttgcccagctgctcgtccaaggccctcccggctctctccctgccacctccatcccagcagggtccacgcccaccgtgcaggtcacgcctcagctagagaccaagagcattggggccagcgttgagttccactgtgctgtgcccagcgaccggggtacccagctccgttggttcaaggaagggggtcagctgcctccgggtcacagcgtgcaggatggggtgctccgaatccagaacttggaccagagctgccaagggacgtatatatgccaggcccatggaccttgggggaaggcccaggccagtgcccagctggttatccaagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgcaggtacctacgtctgcaccgccactaaccgccagggcaaggtcaaagcctttgcccacctgcaggtgccagagcgggtggtgccctacttcacgcagaccccctactccttcctaccgctgcccaccatcaaggatgcctacaggaagttcgagatcaagatcaccttccggcccgactcagccgatgggatgctgctgtacaatgggcagaagcgagtcccagggagccccaccaacctggccaaccggcagcccgacttcatctccttcggcctcgtggggggaaggcccgagttccggttcgatgcaggctcaggcatggccaccatccgccatcccacaccactggccctgggccatttccacaccgtgaccctgctgcgcagcctcacccagggctccctgattgtgggtgacctggccccggtcaatgggacctcccagggcaagttccagggcctggatctgaacgaggaactctacctgggtggctatcctgactatggtgccatccccaaggcggggctgagcagcggcttcataggctgtgtccgggagctgcgcatccagggcgaggagatcgtcttccatgacctcaacctcacggcgcacggcatctcccactgccccacctgtcgggaccggccctgccagaatggcggtcagtgccatgactctgagagcagcagctacgtgtgcgtctgcccagctggcttcaccgggagccgctgtgagcactcgcaggccctgcactgccatccagaggcctgtgggcccgacgccacctgtgtgaaccggcctgacggtcgaggctacacctgccgctgccacctgggccgctcggggttgcggtgtgaggaaggtgtgacagtgaccaccccctcgctgtcgggtgctggctcctacctggcactgcccgccctcaccaacacacaccacgagctacgcctggacgtggagttcaagccactcgcccctgacggggtcctgctgttcagcggggggaagagcgggcctgtggaggacttcgtgtccctggcgatggtgggcggccacctggagttccgctatgagttggggtcagggctggccgttctgcggagcgccgagccgctggccctgggccgctggcaccgtgtgtctgcagagcgtctcaacaaggacggcagcctgcgggtgaatggtggacgccctgtgctgcgctcctcgcccggcaagagccagggcctcaacctgcacaccctgctctacctggggggtgtggagccttccgtgccactgtccccggccaccaacatgagcgctcacttccgcggctgtgtgggcgaggtgtcagtgaatggcaaacggctggacctcacctacagtttcctaggcagccagggcatcgggcaatgctatgatagctccccatgtgagcgccagccttgccaacatggtgccacgtgcatgcccgctggcgagtatgagttccagtgcctgtgtcgagatggattcaaaggagacctgtgtgagcacgaggagaacccctgccagctccgtgaaccctgtctgcatgggggcacctgccagggcacccgctgcctctgcctccctggcttctctggcccacgctgccaacaaggctctggacatggcatagcagagtccgactggcatcttgaaggcagcgggggcaatgatgcccctgggcagtacggagcctatttccacgatgatggcttcctcgccttccctggccatgtcttctccaggagcctgcccgaggtgcccgagaccatcgagctggaggttcggaccagcacagccagtggcctcctgctctggcagggtgtggaggtgggagaggccggccaaggcaaggacttcatcagcctcgggcttcaagacgggcaccttgtcttcaggtaccagctgggtagtggggaggcccgcctggtctctgaggaccccatcaatgacggcgagtggcaccgggtgacagcactgcgggagggccgcagaggttccatccaagtcgacggtgaggagctggtcagcggccggtccccaggtcccaacgtggcagtcaacgccaagggcagcgtctacatcggcggagcccctgacgtggccacgctgaccgggggcagattctcctcaggcatcacaggctgtgtcaagaacctggtgctgcactcggcccgacccggcgccccgcccccacagcccctggacctgcagcaccgcgcccaggccggggccaacacacgcccctgcccctcgtaggcacctgcctgccccacacggactcccgggccacgccccagcccgacaatgtcgagtatattattattaatattattatgaatttttgtaagaaaccgaggcgatgccacgctttgctgctaccgccctgggctggactggaggtgggcatgccaccctcacacacacagctgggcaaagccacaaggctggccagcaaggcaggttggatgggagtgggcacctcagaaagtcaccaggacttggggtcaggaacagtggctgggtgggcccagaactgcccccactgtccccctacccaccgatggagcccccagatagagctgggtggcctgtttctgcagcccttgggcagttctcactcctaggagagccaacctcggcttgtgggctggtgccccacagctacctgagacgggcatcgcaggagtctctgccacccactcaggattgggaattgtctttagtgccggctgtggagcaaaaggcagctcacccctgggcaggcggtccccatccccaccagctcgtttttcagcacccccacccacctccacccagcccctggcacctcctctggcagactccccctcctaccacgtcctcctggcctgcattcccaccccctcctgccagcacacagcctggggtccctccctcaggggctgtaagggaaggcccaccccaactcttaccaggagctgctacaggcagagcccagcactgatagggccccgcccaccgggccccgcccaccccaggccacatccccacccatctggaagtgaaggcccagggactcctccaacagacaacggacggacggatgccgctggtgctcaggaagagctagtgccttaggtgggggaaggcaggactcacgactgagagagagaggagggggatatgaccaccctgccccatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccccgcc

SEQ ID NO: 13477 - DNA, 828 bp, Homo sapiens
gtgacccatgggctgagggcatacgatggcttgtctctgcctgaggacatagagaccgtcacagcaagccaaatgcgctggacacattcgtacctttctgatgatgaggacatgctggctgacagcatctcaggagacgacctgggcagtggggacctgggcagcggggacttccagatggggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacagtgccccagttcccaagagcctgcacggaggccgagtttgcctgccacagctacaatgagtgtgtggccctggagtatcgctgtgaccggcggcccgactgcagggacatgtctgatgagctcaattgtgaggagccagtcctgggtatcagccccacattctctctccttgtggagacgacatctttaccgccccggccagagacaaccatcatgcgacagccaccagtcacccacgctcctcagcccctgcttcccggttccgtcaggcccctgccctgtgggccccaggaggccgcatgccgcaatgggcactgcatccccagagactacctctgcgacggacaggaggactgcgaggacggcagcgatgagctagactgtggccccccgccaccctgtgagcccaacgagttcccctgcgggaatggacattgtgccctcaagctgtggcgctgcgatggtgactttgactgtgaggaccgaa

SEQ ID NO: 13478 - DNA, 856 bp, Homo sapiens
aaggatatggatggagtgtgtgagtgctcagatgaaccgatgaagattgaatcagtgtgaaccgggcatggtggaacgcacctgtagtcccacctactcaggaggctaagctgggagcattgcttgagcgcatgaattctaggctgtggtgagccgtgatcacacctgtgaatacaaccaagaccctttgtctaaaaaaaaaaaagaagtggacacgtgagtgagtaaatgcataagacctgacaagtgagtgtgtttgtgagtgaatgcatgaaaaagtgaatgaggagtgaatgaatgctggagcttcagtgctcacctttccttgggcagtctatggcctccctcgggccaggcctgcagtgactgatctcactggacctctgcctccctcctccccagccctgccctcggtgctcatcaacatccggacctctgtgcagaccgtggtggttggccacgccgtggagttcgaatgcctggcactgggtgaccccaagcctcaggtgacatggagcaaagttggagggcacctgcggccaggcattgtgcagagcggaggtgtcgtcaggatcgcccacgtagagctggctgatgcgggacagtatcgctgcactgccaccaacgcagctggcaccacacaatcccacgtcctgctgcttgtgcaagccttgccccagatctcaatgccccaagaagtccgtgtgcctgctggttctgcagctgtcttcccctgcatagcctcaggctaccccactcctgacatcagctggagcaagctggatggcagcctgccacctgacagccgcctggagaacaacatgctgatgctgccctcagtccgaccccaggacgc

SEQ ID NO: 13479 - DNA, 589 bp, Homo sapiens
cacgcccagtggcctctacctgggtacctgtgaacgctgcagctgccatggccactcagaggcctgcgagccagaaacaggtgcctgccagggctgccagcatcacacggagggccctcggtgtgagcagtgccagccaggatactacggggacgcccagcgggggacaccacaggactgccagctgtgcccctgctacggagaccctgctgccggccaggctgcccacacttgttttctggacacagacggccaccccacctgtgatgcgtgctccccaggccacagtgggcgtcactgtgagaggtgcgcccctggctactatggcaaccccagccagggccagccatgccagagagacagccaggtgccagggcccataggctgcaactgtgacccccaaggcagcgtcagcagccagtgtgatgctgctggtcagtgccagtgcaaggtcagtccgaatccctgtccctgcggggcctgctctgccccgctgcccagaccctgcggggaaatcaggcagcatctggtggaagccgagacctgggcatggggggcagggcatgggggacagggcaggggctgcccg

SEQ ID NO: 13480 - DNA, 2433 bp, Homo sapiens
gcaggccgcaccgtcaggctgtactgcagggctgcaggcgtgcctagcgccaccatcacctggaggaaggaagggggcagcctcccaccacaggcccggtcagagcgcacagacatcgcgacactgctcatcccagccatcacgactgctgacgccggcttctacctctgcgtggccaccagccctgcaggcactgcccaggcccggatccaagtggttgtcctttcagcctcagatgccagcccaccgccggtcaagattgagtcctcatcgccttctgtgacagaagggcaaacactcgacctcaactgtgtggtggcagggtcagcccatgcccaggtcacctggtacaggcgagggggtagcctgcctccccacacccaggtgcacggctcccgtctgcggctcccccaggtctcaccagctgattctggagaatatgtgtgccgtgtggagaatggatcgggccccaaggaggcctccattactgtgtcttactgcccacctgcttggtcatggtgtgtgcccggcagcacccggcccatccgcatcgagccctcctcctcacacgtggcggaagggcagaccctggatctgaactgcgtggtgcccgggcaggcccacgcccaggtcacgtggcacaagcgtgggggcagcctccctgcccggcaccagacccacggctcgctgctgcggctgcaccaggtgaccccggccgactcaggcgagtatgtgtgccatgtggtgggcacctccggccccctagaggcctcagtcctggtcaccatcgaagcctctgtcatccctggacccatcccacctgtcaggatcgagtcttcatcctccacagtggccgagggccagaccctggatctgagctgcgtggtggcagggcaggcccacgcccaggtcacatggtacaagcgtgggggcagcctccctgcccggcaccaggttcgtggctcccgcctgtacatcttccaggcctcacctgccgatgcgggacagtacgtctgccgggccagcaacggcatggaggcctccatcacggtcacagtaactgggacccagggggccaacttagcctaccctgccggcagcacccagcccatccgcatcgagccctcctcctcgcaagtggcggaagggcagaccctggatctgaactgcgtggtgcccgggcagtcccatgcccaggtcacgtggcacaagcgtgggggcagcctccctgtccggcaccagacccacggctccctgctgagactctaccaagcgtcccccgccgactcgggcgagtacgtgtgccgagtgttgggcagctccgtgcctctagaggcctctgtcctggtcaccattgagcctgcgggctcagtgcctgcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtgcatggctcgaggctacgcctgctccaggtgaccccagctgattcaggggagtacgtgtgccgtgtggtcggcagctcaggtacccaggaagcctcagtccttgtcaccatccagcagcgccttagtggctcccactcccagggtgtggcgtaccccgtccgcatcgagtcctcctcagcctccctggccaatggacacaccctggacctcaactgcctggttgccagccaggctccccacaccatcacctggtataagcgtggaggcagcttacccagccggcaccagatcgtgggctcccggctgcggatccctcaggtgactccggcagactcgggcgagtacgtgtgtcacgtcagtaacggtgcaggctcccgggagacctcgctcatcgtcaccatccagggcagcggttcctcccacgtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtg

SEQ ID NO: 13481 - DNA, 637 bp, Homo sapiens
cctgaggacatagagaccgtcacagcaagccaaatgcgctggacacattcgtacctttctgatgatgaggacatgctggctgacagcatctcaggagacgacctgggcagtggggacctgggcagcggggacttccagatggtttatttccgagccctggtgaatttcactcgctccatcgagtacagccctcagctggaggatgcaggctccagagagttccgagaggtgtccgaggctgtggtagacacgctggagtcggagtacttgaaaattcccggagaccaggttgtcagtgtggtgttcatcaaggagctggatggctgggtttttgtggagctggatgtgggctcggaagggaatgcggatggggctcagattcaggagatgctgctcagggtcatctccagcggctctgtggcctcctacgtcacctctccccagggattccagttccgacgcctgggcacaggtgagcctatcctggtgtctgggatcgcctcctccagactcgtggggtcccctttcagtgtctctgccataggctcccaacttgggcttgcacaccactagaaacagggagctcactactcctgagtctgccccatcgatctttacacaatcttggcttggtaga

SEQ ID NO: 13482 - DNA, 621 bp, Homo sapiens
ggtgagagcagagagggcagggggtacagacaagtggcgcagagggtggcagagaggtccccggtgccatcactgttatctcactctggctgcgtggtccacacccgtctgtccccagtgcccagcgtctccccaccgatcaggatcgagtcgtcttcccccacggtggtggaagggcagaccttggatctgaactgcgtggtcgccaggcagccccaggctatcatcacatggtacaagcgtgggggcagccttccctcccgacaccagacccatggctcccacctgcggttgcaccaaatgtctgtggctgactcgggcgagtatgtgtgccgggccaacaacaacatcgatgccctggaggcctccatcgtcatctccgtctcccctagcgccggcagcccctccgcccctggcagctccatgcccatcagaattgagtcatcctcctcacacgtggccgaaggggagaccctggatctgaactgcgtggtccccgggcaggcccatgcccaggtcacttggcacaagcgtgggggcagcctccccagtcaccatcagacccgcggctcacggctgcggctgcaccatgtgtccccggccgactcgggtgaatacgtg

SEQ ID NO: 13483 - DNA, 2324 bp, Homo sapiens
atttcccagacggggtggttgccggacggaggggctcctcacttctcagacggggcggttgccaggcagagggtttcctcacttctcagacggagcggccgggcagagacgctccccacctcccagacagggctgcggcccagcagaggcactcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggctgctgggcagaggctgcaatctcggctctccgggaggccaagtgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaactttt

SEQ ID NO: 13484 - DNA, 717 bp, Homo sapiens
agggcggggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagagtcttgctatgtcacccaggctggagtgcggtggcaccatctcggctcactccaagctctgcctcccgggttcacaccattctcctacctcagcctcctgagtag

SEQ ID NO: 13485 - DNA, 5236 bp, Homo sapiens
gggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggactttgagtaaatttcttagcatatcaaa

SEQ ID NO: 13486 - DNA, 5249 bp, Homo sapiens
atgacgggcgcgcgggcgtccgcggcggagcagcgcagggcggggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatgg

SEQ ID NO: 13487 - DNA, 1849 bp, Homo sapiens
atgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaaaacccaaagatgtcaatactgtgggatcatctgaatctaaaagggcattacctaattcttcagaagaaaggtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataa

SEQ ID NO: 13488 - DNA, 2121 bp, Homo sapiens
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaa

SEQ ID NO: 13489 - DNA, 2295 bp, Homo sapiens
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataagctatcctcacactcacggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcagaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaa

SEQ ID NO: 13490 - DNA, 1443 bp, Homo sapiens
atgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttatgtggtcaagaatgtcaatgctttggcctgccgctaccgataa

SEQ ID NO: 13491 - DNA, 3602 bp, Homo sapiens
gttaggtggagacagggtaggttgggacacaaagtccagttaagtgtgtgtcccagctcagtgctctgagcccagatcctcatctccctgggtagtgaggctcagcacagacaagcaaccaactgctgggctgccggtgccccccatgttggaacctgagttggagattatctcctaagcagatacctgcttccaaactggggatgtagggcttggaaactagaaaatgccaggtctgagggagaggaaagaacaagtccagcaatacacagagctctgtgtattcagagggaagttggcagggttgtgttcgggcagagaaactccgagtggtacaaaggggacgtgcccagagtggagaaatcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggactccccggagaccgaggagaacccggccccggagcctcgaagcgcgacggagcccggcccgcccggctactccgtgtctcccgccgtgcccggccgctcgccggggctgcccatccgctctgcccgccgctacccgcgctccccagcgcgctccccagccaccggccggacacactcgtcgccgcccagggccccgagctcgcccggccgctcgcgcagcgcctcgcgcacactgcggactgcgggcgtgcacataatccgcgagcaagacgaggccggcccggtggagatcagcgcctgagccgcctcgggatcccctgagaggcgcccgcggtctgcggccagtggcccgggggaaagctggggctgggaagcccgggcgcggcgcgctggggacgaggggaggtcccgggggggcgctggtgtctcgggtgtgaacgtgtatgagcatgcgcagacggaggcgggtgcgcggaggcggcagtgttgatatggtgaaaccgggtcgcatttgcttccggtttactggctgtgtcctcacttggtataggttgtgccctcttaggaccacatagattattacatttctggcccaatacccaaaagggttttatggaaactaacatcagtaacctaacccccgtgactatcctgtgctcttcctagggagctgtgttgtttcccacccaccacccttccctctgaacaaatgcctgagtgctggggcactttttttttttttttttttttttttttttttgcaagttcagattagagaggccactttcccagaatccacagctgcactaagctaaggagaagccagatgccggttactgggtgtgcaggggctgttctgagctggggggatcattgtgaaggccttcttccctgggcacctggtacctggggacctacaaggtggtgagggaagggtacgagtacattccttttccctctgacctgggcgctagcaagggcaaagaacccgagcctgccagcttggcctcctcccacagcctccctcggaggcatgccatgccaagcactctttctgtctctgttcatgaataaaagagatggatgggcttattcttatagagaagtgaatttcacttactcccctggcccgaaaactagaccaaatgaggaactgttttagctcatcaaactcatatattcctcctggcttccttacaaaacaagcctttcaaacaatcattgtcctcaggaaagttgttgagcttcctccagctgtgagaataagtcctaatctccagagaaatggtggggggaggaggaggcttattgcttcccagcatttggggggaacatgatccaacccctggcctcctgccacccatctgccctgctcccacatgctcaggtcccagggcacagaaaaagggcagactccctaatcacactaacatcaaaataaagaggctgggccgctgtgtagccaggacatgcccatgccaccgcctattgaacagttcataggagtggcagtaatctactgtgtgaggagagagggcaattaaaaagctgaaagagaaggaggccctctgtgtattccattccctcctccttaatgcctccaagggtccttgcatccctagtctcctaaactccagctctgattcgccatcaacccatggagcaattccaaggccccagttacccatcacctccacaccaggtcaagttttgtctcagccccaaaggcactgacatttctagtttgccccctctgccctgaaccccacagcatgcctgtctcagctccctgtccctcggcacttccccaggctcatttgagcaggtgtgccttcgcagctcccctaaacttcccaggtgcctcatccataatgagataatgcatgtaggggaaaagtttctcaagaaggtggaagaggcagcaggacttggataaggagtacctgctggtcagccttgagatgcacaggtgaaggttagggtgagatgagaacatgccataccctggtgctgaatccctgaggggccagcttgccaggcttaagccaaatctgccttaaattgggggtggggaggggtaagtaaggaagtggggtttgtttttgtgttgttttcatcttcatctttgtattactagcatccagcagagtgcctagcacatactggatgctcaataaacttttgatgaaatgaaatgacaactttattccacataaacaagggtaacaaaacaagctgcttaaata

SEQ ID NO: 13492 - DNA, 1510 bp, Homo sapiens
gttaggtggagacagggtaggttgggacacaaagtccagttaagtgtgtgtcccagctcagtgctctgagcccagatcctcatctccctgggtagtgaggctcagcacagacaagcaaccaactgctgggctgccggtgccccccatgttggaacctgagttggagattatctcctaagcagatacctgcttccaaactggggatgtagggcttggaaactagaaaatgccaggtctgagggagaggaaagaacaagtccagcaatacacagagctctgtgtattcagagggaagttggcagggttgtgttcgggcagagaaactccgagtggtacaaaggggacgtgcccagagtggagaaatcatgctaattgtctgcactagagctggagaacgccacccaaaatgaagagagaaaggggagccctgtccagagcctccagggccctgcgccttgctccttttgtctaccttcttctgatccagacagaccccctggagggggtgaacatcaccagccccgtgcgcctgatccatggcaccgtggggaagtcggctctgctttctgtgcagtacagcagtaccagcagcgacaggcctgtagtgaagtggcagctgaagcgggacaagccagtgaccgtggtgcagtccattggcacagaggtcatcggcaccctgcggcctgactatcgagaccgtatccgactctttgaaaatggctccctgcttctcagcgacctgcagctggccgatgagggcacctatgaggtcgagatctccatcaccgacgacaccttcactggggagaagaccatcaaccttactgtagatgtgcccatttcgaggccacaggtgttggtggcttcaaccactgtgctggagctcagcgaggccttcaccttgaactgctcacatgagaatggcaccaagcccagctacacctggctgaaggatggcaagcccctcctcaatgactcgagaatgctcctgtcccccgaccaaaaggtgctcaccatcacccgcgtgctcatggaggatgacgacctgtacagctgcatggtggagaaccccatcagccagggccgcagcctgcctgtcaagatcaccgtatacagaagaagctccctttacatcatcttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaaggtgagctcccagccacccaatcacccatcccatcaacaatcagatcagtgggctgctgggaaaaggcagaactgggcgacaaggaaaacagctctgcagggacccttccctctgacctgggcgctagcaagggcaaagaacccgagcctgccagcttggcctcctcccacagcctccctcggaggcatgccatgccaagcactctttctgtctctgttcatgaataa

SEQ ID NO: 13493 - DNA, 5599 bp, Homo sapiens
actcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttc

SEQ ID NO: 13494 - DNA, 1385 bp, Homo sapiens
acatttaaaagagcttcgggcacccggcctccctgggtcccgctcctgcggcgcgggtgggaggtgtaacttgacagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttat

SEQ ID NO: 13495 - DNA, 1845 bp, Homo sapiens
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaa

SEQ ID NO: 13496 - DNA, 1807 bp, Homo sapiens
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggtttgagccaccgcgcccggccctgtttcctttttgtttgttcccctgataccctgtatcaggaccaggagtcagtttggcggttatgtgtggggaagaagctgggaagtcaggggctgtttctgtggacagctttccctgtcctttggaaggcacagagctctcagctgcagggaactaacagagctctgaagccgttatatgtggtcttctctcatttccagcagagcaggctcatatgaatcaaccaactgggtgaaaagataagttgcaatctgagatttaagacttgatcagataccatctggtggagggtaccaaccagcctgtctgctcattttccttcaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaatgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgct

SEQ ID NO: 13497 - DNA, 774 bp, Homo sapiens
agagacggggtttcacccttttagccaggatggtctcgatctcctgacttcgtgatctgcccgccttggcctcccaaagtgctaggattacaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaa

SEQ ID NO: 13498 - DNA, 1449 bp, Homo sapiens
cccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgctaaaactggctcaatccttctgatcattgcagttttctctcaaatatgaacactttataattgtatgttctttttagaccccataaatcctgtat

SEQ ID NO: 13499 - DNA, 1493 bp, Homo sapiens
attctcctgcctcagcctcccgagtagctgggactacaggcgccagtgaccacgcccggctaattttttgtatttttagtagagacggggtttcacccttttagccaggatggtctcgatctcctgacttcgtgatctgcccgccttggcctcccaaagtgctaggattacaggctgatcccataatgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgagtgcagaagactgaacagacatcagcacatcagacgtcttttagaccccaagacaatttttctgtttcagtttcatctggcattccaacatgtcagtgatactgggtagagtaactctctcactccaaactgtgtatagtcaacctcatcattaatgtagtcctaattttttatgct

SEQ ID NO: 13500 - DNA, 868 bp, Homo sapiens
gccacgaactgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaa

SEQ ID NO: 13501 - DNA, 1434 bp, Homo sapiens
tttcatttcatcaaaagtttattgagcatccagtatgtgctaggcactctgctggatgctagtaatacaaagatgaagatgaaaacaacacaaaaacaaaccccacttccttacttacccctccccacccccaatttaaggcagatttggcttaagcctggcaagctggcccctcagggattcagcaccagggtatggcatgttctcatctcaccctaaccttcacctgtgcatctcaaggctgaccagcaggtactccttatccaagtcctgctgcctcttccaccttcttgagaaacttttcccctacatgcattatctcattatggatgaggcacctgggaagtttaggggagctgcgaaggcacacctgctcaaatgagcctggggaagtgccgagggacagggagctgagacaggcatgctgtggggttcagggcagagggggcaaactagaaatgtcagtgcctttggggctgagacaaaacttgacctggtgtggaggtgatgggtaactggggccttggaattgctccatgggttgatggcgaatcagagctggagtttaggagactagggatgcaaggacccttggaggcattaaggaggagggaatggaatacacagagggcctccttctctttcagctttttaattgccctctctcctcacacagtagattactgccactcctatgaactgttcaataggcggtggcatgggcatgtcctggctacacagcggcccagcctctttattttgatgttagtgtgattagggagtctgccctttttctgtgccctgggacctgagcatgtgggagcagggcagatgggtggcaggaggccaggggttggatcatgttccccccaaatgctgggaagcaataagcctcctcctccccccaccatttctctggagattaggacttattctcacagctggaggaagctcaacaactttcctgaggacaatgattgtttgaaaggcttgttttgtaaggaagccaggaggaatatatgagtttgatgagctaaaacagttcctcatttggtctagttttcgggccaggggagtaagtgaaattcacttctctataagaataagcccatccatctcttttattcatgaacagagacagaaagagtgcttggcatggcatgcctccgagggaggctgtgggaggaggccaagctggcaggctcgggttctttgcccttgctagcgcccaggtcagagggaaaaggaatgtactcgtacccttccctcaccaccttgtaggtccccaggtaccaggtgcccagggaagaaggccttcacaatgatccccccagctcagaacagcccctgcacacccagtaaccggcatctggcttctccttagcttagtgcagctgtggattctgggaaagtggcctctctaatctgaacttg

SEQ ID NO: 13502 - DNA, 2906 bp, Homo sapiens
cggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggacccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttc

SEQ ID NO: 13503 - DNA, 2648 bp, Homo sapiens
gaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggacccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcag

SEQ ID NO: 13504 - DNA, 3340 bp, Homo sapiens
gcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgattttgttgccgctgcgtctcgccagattgaggcatcccctccgacatcactggagcatatctggaggggtggacagttctccacagggagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaa

SEQ ID NO: 13505 - DNA, 3235 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaa

SEQ ID NO: 13506 - DNA, 1470 bp, Homo sapiens
cactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagcc

SEQ ID NO: 13507 - DNA, 3329 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgttttgttgccgctgcgtctcgccagattgaggcatcccctccgacatcactggagcatatctggaggggtggacagttctccacagggagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 13508 - DNA, 3209 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 13509 - DNA, 1603 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatga

SEQ ID NO: 13510 - DNA, 1339 bp, Homo sapiens
ggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagcc

SEQ ID NO: 13511 - DNA, 1728 bp, Homo sapiens
ggagcctcggttcccctcgggcggctgaaggaggggctgagcctcaggacccctaggccaggccgtgttgaaagcagataccccgaggcctcgcccagcctgcgctggagggaagaaggcgctggaggagcaccagcgaaagcagccagtctgagatattgacactacagaaaaaactgacagcttactccttgtattgattctactcttctctacaaatatagactccgttccctaccacagccttatagttctgccccagagacaagtatgaataccacagacaacggtgtcaactgtctgtgtgctatctgtggggacagagcaacaggaaaacactatggggcatccagctgtgatgggtgcaagggtttcttcagacgcagcattcgtaagagtcacgtttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaggatagcacttttggcaaactcttagccaaggcttcttcattggtgctgttataagatggtgtcctattttcttgtttatacgttcattctgtttgttattgctactatgtaaaactttcacatgcaaccaatgtatatctgagtttgaagatgtttatatagggta

SEQ ID NO: 13512 - DNA, 4209 bp, Homo sapiens
ggattagcactcacagattgaaagcaaaacacatcaaaacactcatcacgcactctgggcttgtggtgccacttgtatgtgtgtttctaaatcaatgatgagggtatcagaaccaatactggacatggacatggcaaattacagtgaagttttggacccaacttacacaactttggagtttgaaactatgcagattctatataattcaagtgatagttctgccccagagacaagtatgaataccacagacaacggtgtcaactgtctgtgtgctatctgtggggacagagcaacaggaaaacactatggggcatccagctgtgatgggtgcaagggtttcttcagacgcagcattcgtaagagtcacgtttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaggatagcacttttggcaaactcttagccaaggcttcttcattggtgctgttataagatggtgtcctattttcttgtttatacgttcattctgtttgttattgctactatgtaaaactttcacatgcaaccaatgtatatctgagtttgaagatgtttatatagggtattttttccaactgcccctgcattgtgcctgaaccaattgaatcttatgtatgagtttcatttgttttattaatgttaatttaaatctgtaaataattgctttattgtgatgtgatacagaacaaagtgttcgtttttgactgaaaatagtagatcagaaatctcagtttaatataaaatgagctaagtttttaaaaataaattataaacttggagattagaaaaataaagcagttgctgtagaataggctgtatctttttcaagaagaatctcttatggacagtctgtggtaaagaagcaactctttgctttagagttaaatattcctatcttaagtttagaaaaatacaaaaaaccattccaaggatgactggatactttttgaaatctgactttctttgaagatgtatgttaagcaaaaacatgttgcttttatcagttaggatacagggtgaactgtaacaaagaaacccctaaaacagtgactaaatcaagagaggaatctatttctttctcctgaaacaatttagaaaatagttatccattgactagaaattagtacatgcccacagctggctcccacggtagccaggagaattatctataggtggaaagtctgtgtcagccaaagccatgtcactctgagagaactgattctgaggacaagttagccatctaccacccatgtcccttatttggtcctcacaataacactttaggagagatatcattatcgctgttttataaataagggaaactttagcttgagggtttaaggaacataaccaaagttcacaaacataacgagtgagagaaacacattcaagcccaggtctagttgactttaatgaatctttggtgtggaatgaaaaatgtgaacttcttactcatagtgtggtttttaaatatatgcagttgagtgatgattggatactattcatcatattgcctataatatatatttaccgataagcagtgagtgtaaaattgttgtagcttgaataagaaaccacttttgtagttttaaccagactttctcttaaaaacattagataaaataaaagattcaccggatggattctgatgaaaacgaaaacaaagtaaaatgactggcttagcagattctttgaaatgtagcagcccagggatgtaccaaatgtcgaattctagactgaggagtagagttcattggagtcttaaactctctgatatcacttaaagctggagtttattttaaaacaaatgaagcatgggccacctcatgatgcagtggctcctctctggttgaggagagggaaaattggaaaaactggtcgagtaattatcaataattttttttaaaaagaggatcccaaactgtaaaagattgaaataatctttctcaggattttttaaatgtctaagattatgatgtcatatctcccacttaccttataagtaaaaaggttaatatcaagtaacttattagctcttaaagtaaaattgaacttattaaaagctatctatgatttaatagatttaataaaattccttcacgacctggtacccttgtgaaactgtaaaatatatcatatggggggagttttttaactcttattttttgaaaatttactgtagcttctatttcgtgaataagaatgttttgattttgatcatacaaataacttttgtagatttttgtttacttttgggggggttcccttagaagacattaaaaaaaaatactgccttggtctgtgcaggctgctgtaatgaaatactatgaacttggcagcttataaacaacagaaatttatttctcgctgttctcaatggtgggaagtccaagattaagggatcaacaaattaggcctctggatcatacatggcattttctagctgtgtccttatacataaaaggaaaaaggtagctctctcgagtctctttaataaagatactaattctcatgactgaatcaccctccaaaggccccacctcctaataccatcactctggggactaggtgtcagcatgtgaattttggaaaacacaaaaattcagaacatagcaaatacctttgaagtataaaagataaaattcatttttagtgaaccctgtaatttattcgtgtatatttactaaacagctgtatctttgaaattgttagtaatgattctgcttcaataactatggtcagggaatttataatattatatttttatatactgaactgccatagatgctggaaaaaaggaactgatgttttcagcatattttcaaaatattgataagggaagttattacttttatatagtattcaacttttttcaggtaatagaagtgaataatttattgtgaaataattcattttataaatgtataattatttttataaattttattgttggaaatcaaaaattagtagattttttaccatgttaaattatagtgagattaaagtattactaaactgtgatgctatgtttgtttcactaaactttctaaataaaaactgagaaaaaaaaaatcactgaaa

SEQ ID NO: 13513 - DNA, 2380 bp, Homo sapiens
gaggaggagtggggaccgggcggggggtggaggaagaggcctcgcgcagaggagggagcaattgaatttcaaacacaaacaactgcacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactata

SEQ ID NO: 13514 - DNA, 960 bp, Homo sapiens
agaactgagctcatctttgcggggttagctagccgttgagtccaagtctccttggcaagacagtagcttagagaaacgagatcgaatgcacccggaaggtggccaatttgtgcctcaactccttggccatctcctggctaccaaactcaagcgtttcctccttagcaaaggcggacgtagggctcaaatccccgacgtttccagggccaccccccatacgattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccacccc

SEQ ID NO: 13515 - DNA, 2171 bp, Homo sapiens
atacggtaagcacggcgaggtccagagaggaccccagtgcgcggagcggcacggcgcccactcctctcgccctcggcgcctagcacgctgccaagaaccgcgggtgcccagtaaatatttgtggattgagatggagcagagggcaggcggaaaccgtgtacagacgtccacacttaactgcgctggggccgcggtgattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 13516 - DNA, 992 bp, Homo sapiens
accgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtctttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagccctcccccctcctgcacagagccctgcctgcccggccagtgggtttaccccggggctaatccgacagagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagaggtgagtgagccccctgaccccttggcagctggactaggggggaccggccactctcggagaagaggatgaaaagggcctgcagtggtcagcctctcgggaggcagggtgggctctcctaggagaccggcactggct

SEQ ID NO: 13517 - DNA, 1292 bp, Homo sapiens
ataacaccgggaagggcacgagcgctccgcgcggagcgggcagagattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccattttt

SEQ ID NO: 13518 - DNA, 2073 bp, Homo sapiens
gcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 13519 - DNA, 4228 bp, Homo sapiens
ggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactg

SEQ ID NO: 13520 - DNA, 4854 bp, Homo sapiens
tttgtgtctatttttttaaacattacatttgtcataatcattcatattgttgtgtgtagttgtagtttgttcattattattgctataaagaatttcattttatgaataaaatgcaatgtattcattcattatagtgttcacgaacattttgactgtttctattttgggtttatgaatattctagtaaatattttttagtaaattctcacttgttgttaagtacaatttatagaggataggaagtggcaacaacaatgagtgttccccttttgcctatgggaaaagagaggcaaagggagaattagtgttagtggcccaataaggcttctggtgcctgtttcctgattcttgggacagagcacattcttcctgctacaccattgaaaaaactggatccagatctctcttctgaaggaactagtaatacatgattagcagcacgggtgactttttaactatgcccttcaaaatccaatcattgaaaacttattgaattaaaaggaatcaggtaagttaaagaaactgggctaaatgggttttgctttctcagtcactcaacctggctcttgcctcttcagttttctggacacgtagaaagcccctttgttctctttcttctacaccagcagtttttatttgcctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacact

SEQ ID NO: 13521 - DNA, 4490 bp, Homo sapiens
actgagcatttctaagggagttgaggctggtggctcctccttccttcctactggtgcttccacctgccttggtctgagttgcagtccatggggcagcgcctaagtgtctgagcacacttaagaatctctagtggtttatgacccagactttgccctaccacctcagtcttctgaatgttctcttccctggaccctgctccagacactttaaattcagaagaggaaaatgtgcccagcctgcctggagaaaagtgtctgctcctagccaagatctcctcatcacaaaagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactg

SEQ ID NO: 13522 - DNA, 3694 bp, Homo sapiens
gtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttag

SEQ ID NO: 13523 - DNA, 2459 bp, Homo sapiens
cctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatgatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctg

SEQ ID NO: 13524 - DNA, 4310 bp, Homo sapiens
ggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaaca

SEQ ID NO: 13525 - DNA, 838 bp, Homo sapiens
aaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaaga

SEQ ID NO: 13526 - DNA, 6013 bp, Homo sapiens
aattctaggggctgccatggcttggctaagcttcccttgaccactgagcatttctaagggagttgaggctggtggctcctccttccttcctactggtgcttccacctgccttggtctgagttgcagtccatggggcagcgcctaagtgtctgagcacacttaagaatctctagtggtttatgacccagactttgccctaccacctcagtcttctgaatgttctcttccctggaccctgctccagacactttaaattcagaagaggaaaatgtgcccagcctgcctggagaaaagtgtctgctcctagccaagatctcctcatcacaaaagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaagactgaatttggtgatttttgacagtctctgtggcttctgtcactgtgattgaaacagaaaatacttagggggtgagtgagtatagtatgtatttgtctagcctttgtagaacctacaagtttttgttttagagatgaggaagctgttccagaggaagcatcaaagagtgctgggtaccaccctagaaaaggagctgtcgcataaatgacaaaaattttctgagtgtcaagaaaatttgccagagggaaatagaagtctgagacgagactcaaacctgtccagtgggccaggggaagtaggaccatatcttatggggcctttttggcagtggtggtgtgaaaggtctagttgcaactttgggggcttccttataggatggagtcattctttctggtattttacagcaatattcctttgttacatgcaaatttgagccaaatattggttagagagcacagataagtgataaattttagattgggtaagatggcccaccccactgcaatatccataatattgtaccacatggcaagtggagaacagaagaggtatcaaggagagaaaagatgataactatgtactgttttacactttaaaaagcattttaattcttgattgcgtttggattacctcagggcaagtcattttacatttgagtaatgttatccatttatacatttgagtgaacaaaagcttatggacattaagtaacttcatccaagatccctcaggtagaagttgagcagggattcatgtattcatctgtttgactccaaatacctatttcatcctcatatatcatggaaacatccactaatctccatccaccttacccatattgattccaacttttctgtctgtccagcaatctgtctgtctaggtagcaatctcttgaagataaaatgtagaaactcacagagctggtgttcagttacgatataagtttggaggagaaaacacaatccagaagctatgattcctcttgtttttccatggtcaatgggtttctggagagctttactgagaatctcagaaataaagtgtgggtggaagggggatttagatggctagttatccaagagttagtgtttaggccattgcagaatcaatgatttaacagcagcagaactgttttggcctgcagttaacatgaatgttaatgaagaccaagtacatgctaggaattccagtcaattaatggttataatttacatgcaactaggaggttcttagcttggtctcagttataactctaagagactaggagaggtagatgagatggaatgcatttcttcttattttgtaatcctgctccaggtcaaggaatagaaactcagagcccatgtatttaagaaagaaatgtatttttgtggtaagtttgctccaagtagggatacaagtatctatttttgacaatcaagtgacattgccatctattcagttgctcaagctggaaattatcagtgtcaacacatc

SEQ ID NO: 13527 - DNA, 2363 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 13528 - DNA, 1783 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 13529 - DNA, 1480 bp, Homo sapiens
agcatggtgtctgttgcaggtggccggactgtgccatgctgctccagacccaaggtggcagctctcactgcggggaccctgctacttctgacagccatcggggcggcatcctgggccattgtggctgttctcctcaggagtgaccaggagccgctgtacccagatgtgcaaaatgaggaccagagaggacatgcagctggggaacgaggggccaggaacagctcttagacttatccacttgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcaga

SEQ ID NO: 13530 - DNA, 3703 bp, Homo sapiens
cgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcaga

SEQ ID NO: 13531 - DNA, 1580 bp, Homo sapiens
gcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggattgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaata

SEQ ID NO: 13532 - DNA, 978 bp, Homo sapiens
cgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatg

SEQ ID NO: 13533 - DNA, 3678 bp, Homo sapiens
gggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcaga

SEQ ID NO: 13534 - DNA, 2778 bp, Homo sapiens
cacgcggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcatatctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctc

SEQ ID NO: 13535 - DNA, 857 bp, Homo sapiens
gctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcaggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggattgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactat

SEQ ID NO: 13536 - DNA, 4665 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcacaaccatgtgtcttcatttataactttttgtttaaaaaatttttagttcaagtttagttcattgatattatcctctgaatgcagttaaggctgggcagaaattctactcatgtgacatctgccacaggtctattttgaagcttttcttctaatggcaatgtttgtccttaccaggatttaatctatagaattgtctctcaactctgcttttctccagttccagataacgtccttaagaccatctgttcaggggttcacaaaactcaaatttgtgtcattctattttatttattttattttttatttccttccctcataccttgcccattccctctgaatattaggtgtgatgtcaacagcatgttagaaggatcaatgggaaggcaatgattgaaaacatttcaatgaaccttaatagtgttcctttgaggagcacccaggagaatatctggtcatagatctttttttaaatgcagttttataaaaccctaacagcggtgatatcattagactgtatgaatcagttttattacctagtgtacaagtgtcagtcatgtatcattatatagtctgttgatctttccatttgcaaaaaattaatagttttcccccacaaatgtacaaagttgtatgcttccagtcttcttttaatgtttatagtcattccaaagtaacattctattttacactttcacatacattgttatgaatcattggtttttctcttttttccacttatcaccaatttatttcattcagccagatttggtgtct

SEQ ID NO: 13537 - DNA, 2246 bp, Homo sapiens
acgtcatcgccgcgcgccggcttgccaggagctggagggggaggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatga

SEQ ID NO: 13538 - DNA, 3786 bp, Homo sapiens
gtgacctaaggcctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 13539 - DNA, 3919 bp, Homo sapiens
atggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 13540 - DNA, 4497 bp, Homo sapiens
ggtaggcggggcggcgcgtgacctaaggcctctctgccgcgcgcgcaggtacggggcagaagtcgcaggtacccagctgctgcccacatttctggtccagagtcccgaaccccgagcactgggatgcctggctactccgagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatacttaggaaaccagaggaatggatttgacttttctgctaggattctctgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaatggcagcatttttttgtgacaaaggtaagggttaagacagtgtgtgtgtgtgtgtgtgtgtgtgtgtgtgtgtgtgtgcgcgcgcgcgcgcgcgcgtaacgtgggcgcatccctcttttccttccctgggttcagtgtggctgggtaaggaccgtctgtttgtagggctgccaggctgcagcctgctgctccagggagcaccagctgcagctgatccaatacaccaagcctgtgtctccctcttctatcacctctctccaggatctctgctgtctcttggatcccatctgcctagatggaagaggatcctatccgaagctaggataaatgttgtcttactcctctgctatgttctcccagaaaaaattgattacaagttctctgctgtggttgctgcagctccaggaagtccccgcaatgtctcacgttgtctttgaccagtggtccccagtaccaggccagcgaagacaactttataatgtcatttgtgttgtgaaaattcttccactgacccaaaatggaaccgtacaaagcctatccgtgtatatggaaaagtctcatgcacctggattaactcagaaaaagtaaagtcctgaaacttca

SEQ ID NO: 13541 - DNA, 3562 bp, Homo sapiens
agaccatgtggttgtatagttaaggttcagtgtttcaaataagagcagtcattgtgggcgcctcgtttttttttctagctactcgtgtcttctccggcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggagaggatgccccgcaggaacatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgctcctgagatgctgacccagcatggagcccaagagcagctcgaagaccatcctggccatagcagccaagcccccattcccagagcagaccctctccccagaaggacccgcaggcccttgttattgcctcgcttagatccaggacagagaggaaacaagcttcccacgggggaacaaggcctggatgaggatgttgatggggtctgtgaaagccacgcagcccctggtctggaatgcagttcaggctcagcaaactgtcagggtgctggcccctctgcagatggaatcagctccaggctgacaccagcagagtcctgcatggggctcgtgaggatgaatctctacactcactgcgtcaaagggctggtgctgtccctgctggctgaggagccgctgctgggagacagcgcagccatagaggaagtgtaccacagcagcctggcttcactgaatgggctggaagtccacctgaaagagacgctgcccagggatgaggcagcctccacgagcagcacctacaacttcacacattacgaccgcattcagagcttgctgatggcaaacctgccgcaggtggccaccccgcaggatcgccgcttcctccaggccgtcagcctgatgcatagcgaatttgcccagctgcccgcgctttatgaaatgactgtcagaaatgcctccacggctgtgtacgcctgttgcaaccccatccaggagacatatttccagcagctggcacctgcagcacggagctccggcttcccaaaccctcaggatggcgccttcagcctctccggcaaagcaaagcagaagctgctgaagcacggggtgaacttgctctgaactgcacccaggaggtgactgggaaggagaaaaccagcaaaggaagctctgccttttataattgaaaaggcccctctattttatttttcttgaaaacattcccttttttaggaaccaaatgatatttgagtttttgttattccttttgcagattgggatgtgttttgggggcaggggttagttcttcaggtcggcagacccagagcacttgataaagaactgtatttaatcggtagtgttggggccgggacgggcttggctccctctctgccatactgagcctgaggtatttcatatctcctgctgttccatcccagcttgaattggtgccacaagcttccaagttggcattttttctagaacctgatcgtccactagcccagagtgtgtgtgttcaacccccacaccaggtggtggtaggcggtgtgactgcacagcgaggtgccggatctgtgagcaggccgactccactcccacgccgcaggtaggtttctccagtgcgctcttgctgggaggtccggatcgttcctgcagggaagcggcagcacacggagaccacttggttgaattctgttggaactctactcaaatctaggggcgtcttctttggacccacaatgggggcaagccttaataatatggaagggagtttgggctttagagatccctttataaaagctctgggggctgagccctgagaattcagtgacaacaggaccaacctgcgctgcctttgactacaagtgggccgtgcagctggttcctctcgagcgagtgtccctaaataggagtttacaagatgtctgggggtaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgctggagttctgagtaattaaa

SEQ ID NO: 13542 - DNA, 4491 bp, Homo sapiens
cgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaaggtgaggaatactgtatctatcattcaacaagtttcagctttctggctaaatggcttttgtgccagtgataccagagtcctacagccatgttcttgcagagtttgaatctctggatccattactctcagccctgcggctggactccagtcgtctaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagct

SEQ ID NO: 13543 - DNA, 4717 bp, Homo sapiens
cgcgaggggagactgaagttcacgttccgctcttagtgcgcggtgagttccccggcgctaagccgggagacaagatccgatctactgagagctgcgaggtactgccctggatgtggtggagctgggctgggacctccgggctgctggtctgtgagcctggctttgaaaattggttactgggtctcctctcaagaaatctcaagatattaaagttactgctgttaaaaagtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagctaattaaaaatatttttccctgtatttatttaatattttctaatctgaacccatatacagctgactaattcattcttagaaatgtgttatctgtaatctttcctaaacagagtagcccacaagaatcatgcactttttaaaattatttctaagaagccataacaaagctgtgtactaataaagactgcagcaagcacttgtgttatttaaattatgtaagtagattgtcatttgtcaggctcctgtacatttacatagcatgttatattaataataaatgtaaaatatgactaaagttttcattggaacacaatgtagacaggaggtttattatgagcattttgcagaaaggtgtggagtaagtaaagtgttggatgcactgaa

SEQ ID NO: 13544 - DNA, 4147 bp, Homo sapiens
cgcgaggggagactgaagttcacgttccgctcttagtgcgcgtgcacgagcatagctgtgtctcggaaatggttggctttgggcagttcaggaggaggactccatctcattcagaaagaaggctggaagcacaggctttttctttcacacagggaaggtgcaatttctcaagtcgcctgttgtttacatgatgatgattatgttgctgtagctaccagtcaaggtcttgtggttgtttgggaattaaatcaagagcgtcgtgggaaaccggaacaaatgtatgtgtcttcagaacacaaaggccgaagagtcacagctctctgctgggatacagctattcttagagtttttgtaggtgatcatgctgggaaggtttctgctatcaaactcaatacttctaaacaagcaaaggcagctgctgcttttgtgatgtttcctgttcagacaatcacaactgttgactcctgtgttgtacagttagattatttggatggaaggctacttatatcttcacttactcgatccttcttgtgtgacactgagagagaaaagttttggaaaattggaaacaaggaaagagatggagaatatggagcttgtttctttcctggaagatgttctgggggccagcaacctctgatatattgtgctcgcccaggctctaggatgtgggaagtgaactttgatggagaagttataagtacacatcagttcaagaaactcctctcgttgccacctctccctgtgattactctcagatcagaacctcagtatgatcatacagctggatcctcccagtctttgtctttccccaaactcttacatcttagtgagcattgtgtgctgacttggacagaaagaggaatttatattttcattcctcagaatgttcaagttcttctttggagtgaagtcaaagatattcaggatgtggctgtctgtaggaatgaattgttctgtttgcacctaaatgggaaagtctcacatctctccctgatatctgtggagcgctgtgtggaacgcctgctaagaagaggcctatggaacttggctgctcgtacatgctgtcttttccaaaattctgtcattgccagcagagcaagaaaaactttgactgcagataaattggagcatttgaaatctcagctggaccatggcacctacaatgatctaatttctcaactggaagaattgatcttaaaatttgaacctttggattcagcttgtagcagtagaagaagctccatttcatcacatgaaagtttcagcatcttggactctggtatttatcgtatcattagtagtagaagaggcagtcagtcagatgaagactcttgctcccttcacagccaaaccctctcagaagatgagagatttaaagaattcacctcacagcaggaagaggacctgccagatcagtgttgtggctcacacggaaatgaagacaatgtttctcatgctccagtgatgtttgagacagataagaatgaaacttttctcccgttcggcattccattaccatttcgttctccatctcctcttgtgtctcttcaggctgtcaaagaaagtgtttctagctttgtgcgtaaaactactgagaagattggcacccttcacacgagccctgatctgaaagtgagaccagagctcaggggtgatgagcaatcatgtgaagaggatgtgagttcagatacctgcccaaaggaggaagacactgaggaggaaaaagaggtaactagtccacctccagaagaagacaggttccaggagcttaaagtagcaacagcagaagcaatgaccaagctacaggaccctctggttttatttgaatccgagtctctgagaatggttttacaggagtggctttcacatttagaaaaaacatttgccatgaaggacttttcaggtgtttcagatactgacaactcatccatgaaattgaaccaggatgtgctattagttaatgaatcaaaaaagggaatattagatgaagataatgaaaaagaaaaaagggactctttaggcaatgaagaatctgttgataaaacagcatgtgaatgtgtaaggagtccaagggagtctttggatgacctgtttcaaatatgttctccatgcgccattgcaagtggtcttcggaacgacctggctgaattgacaacattatgtttggagttgaatgtattgaattctaagatcaaaagcaccagtggacatgtggaccacactttgcaacagtactctcctgaaattctggcttgccagttcctgaagaagtacttttttctcctgaacttgaaaagagcgaaggagagtatcaagcttagttacagtaatagcccttctgtttgggatacttttattgaaggattgaaagaaatggcaagttccaatcctgtgtatatggagatggaaaaaggagatctaccaacaaggttaaagttactagatgacgaggttccttttgatagtccgttgttggttgtttatgctacccggttgtatgaaaagtttggggagtctgctcttcgatccttaatcaagttctttccatccattttgccatcggatatcatacaactttgtcatcatcatcctgctgagtttttggcctatttagacagtctggtgaaatcaaggcctgaagatcagcggtcatcttttcttgagtcccttctgcaaccagagtctttaaggttggattggctgcttttggcagtgtcccttgatgctccaccaagcaccagcacaatggatgatgaaggttatcccaggcctcattcacacttgctttcctggggttacagtcagctgatccttcatctaattaaacttcctgcagattttataaccaaagagaaaatgacagacatctgcaggtcttgtggtttctggcctggatatctaattctctgtttggagctggagagaagaagagaggccttcaccaatattgtgtatctgaatgatatgagcctgatggaaggggacaatggttggatcccagagaccgtggaggaatggaagcttctccttcatctcatacagagcaagagcacgaggccagccccccaggagtcactaaatgggagcctcagtgatgggccttcccccatcaatgtggagaatgtggcacttctgttagctaaggccatgggcccagatcgggcttggtcactgctacaggaatgtggtctggcccttgagttgtcagagaagtttaccagaacctgcgatatcctgaggattgctgagaaaaggcagagggccttgatacaaagcatgcttgaaaaatgcgatcggtttctctggtcccagcaggcctagtgggagaagattcagcaggatgtcatgacattttgagaaaaactaaatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcatttcttaaccaaagttgaattttgaaaagagtcagtccttgtttgctggaattagaatgttaatgtcctagtattattccgaactacagtattaactgcttgttgctagtggattagacagattcttttcttactgtggcttccatgttgggagcagaagcttttcatcctggtcacatgaagacagatggtattattgactggagttgaattatttttatatcttgtctggcacaatatggaaattactgaaataagacggtgtataatggaattaacacccaaaataagtagaacactgaagatttgaatttgatatttaagtaaaatgggactgggtgcagtggctcaggcctgtaatcccaaccctttggaaggtaaagacgggaggatcacttgaggccaggagttcaagaccagcctgggcaacatagtgagaatgcatctctacaaaaaataaaaaaaattagctaggcatagtacctgaggccaggaggtccaggccgcaatgagatgtgtttgtgccattgcacaccagtctgggtgacagagaaagaccctgtctcaaaaacaaattaaataaaatatcttcatatataaattaagct

SEQ ID NO: 13545 - DNA, 2646 bp, Homo sapiens
gctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccagcggggaagctagcaccagcctgggccgcacacacgtcctgctgcaccactgccctgccttcgggctgctggcctcctgcagacaactcttcctggtgcccactgccaccacctggcctggcgtggcccacgttctactcatctggagcccaggcaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcaaaaggaacaatgggatcgggctctggatgctggcctggccctcggcccctccagtcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatat

SEQ ID NO: 13546 - DNA, 4105 bp, Homo sapiens
atgctgggcttcctgtcacgtggtccttcaatgaagctgtgcatgggcctggcatgtgtcttgtccctttggaacacagtgtctggcatcaaaggagaagccaagaaagagaagggaatgacctttttacctacaacagtgtctggccttagagaagaagagaggaaggagaagggggtggcatttcttgctacgacggagctgcccgcaaggtcaatcgatctgtccgcgcttaacctgacagagcttgtgaatgggatgctcagtagagcgttaaaagatagcaagaagttcttctccttgctgagtgtcacttcctacagttccttcgccttccacaagttttctgtagctgtttacaacatttctaacctgaagacagtagaccccgccaaattccccacaaggtattgctactgtttaaacaatcggaccaatgacttatcagattttacagctctactggtagatatcatcggcaattctaccagctacctcacagagatttttaagtcaacctccatcctctcagtgaatcaaagcaatgaatcagattgcatcttcatctgtgtgatgacaggaaagtcaggaaggaatctttctgacttctgggagatagaagaaaaatatcccattatcaattacacatttaccagcggcttgtctggtgttctgggtgcagctaccaggggaactgccaggacttcaaagcccacaaccaaaagccagaaaacactaccaagtacaagccccggacactggacccagagcacaccctgggcatctgctctgagatcctctccctggacagagacagctgctccttcagaaacagaggagaccctgaacacaggcaggcctcctgagcttccagccagggccacagccacatggttcagtgcctcccacactctcccagccttggctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctaccttgggagcattcacccatggcacacagactccgagtccaaccaaggcaacagcccccagatatccacaaacaggtgatctctctgcagagtggccattcactgctggtgaagagccagtcctggtcccaagaccccatcaagtttcaaggtgtcctcagccactcttcaaggtgggagctatggcagctgctcctctcaccctggctattcagaggctcaacccatgcctgatggagctgtgccaattcttccagcaatgcctctgcatgagccagaggagtcccaggacagaggacatgagatactgtcttgaatactattcctggtttctgaagaatgcaacatatatctgtcagagggtgaaaagggtgtcccactcgcacaccttaaagcaaaagtgccttgagaatatctgcaagtctgtgtgaggccttgaaaataacactagggcataacaattacttcaggggatacgccatccaccctggctcttgtcccaagtgggctacatttgaagaattcacccaggctccagctagatcatcagttaatttaaagtggttattcttggaagtagcattttttttccctctcctgtgaatctgtgcaaaacattgaaggtagaagttttcttgttagaggcctcacaattaatacagtaatgccagactccttgcctgcttcaaaatcatggaaatctagtgttcatgctcaagaaactcctacaatgcttgaggcaatcctgacaatttaaaaactggggatgcgtgggcactctagcctgcacaaaccagttcagccatggagactctgacacaatacctgaggtgacttaaacttgagacttttgaaagacaacaaaagcataaattaatattgaattcatactctagagagattcacatatactgatagttaactaatacatgtacaaccaatcagacttgccatggtatgggatctatataatcttccaagcccccttaagtgggcgataatgaaaactttatcattaggaggaggtttagagagttgtttttattgacatcttgtcttgattcctcttctgtgtgacccactggattcagaggtccccatgagcaccctcaggttcaatgattcatgagtagaactcagaggtagggaaaactgttatatgcacatttagcatttattacaacaaaaggatgcagatgaaaagcagcaaatgtgaaaggcacctctagagagagtccaagagagcccaggcacaagcttccagtggggttgcacagtcagcatctaatcctcccagaaataatgtttaacaacacgtggagtattgtcagccaggaaagctcatccaagttttggtgtccaggggatgtttgggggtatggagtaggtatggagtgccttcatggcctgcatggctaaacttagttattcagtctccagtccctctagaggtcaagctgatactgcacgacctaaggccccaccataaatcacattgttaacataaactatctgtcatggcacgaagccccaggtacaagagacactcatcaggcaggatattccaaggatttacaggggattccccaggagctggtcaaggaccagatgttcctctgaaaggtgcaggatttgagctcatctgtggagtacgtctgtggagtcaactttcttctgcatccccacatactgatttgccaccttcattgtatcagattcctttttcactatattcaggtttgcggttgctccagtatccctatctatgctgagtctccacgtagagcatgtgtgccctctccagtggctctgcacggaccccttatttctcattaccagggacagtttttctcctgatgtgcctggtgctccttctccactctcttgccttaggactctgctgggccatgagtattttttttacccttttgtgacctagggctgcccttgggtgaggaaagtcactttctgttcatcatctaagtagaaaacagtttctgccattggaagacccctgagttccctggcactcctgtgaaccacaaggtgcctggggaggtagaacttggacattggagagaggagcagccagacatttctctttctaatcatatgcagaaagatttctttttattctccagaacacttgaaagactctccaagttatgcaaatgtcaagctcataaatgtatattatcatgacttttgcaaagatgaagaggatacagcaaattttctgggaggcaaagggacttctacctggataggaaccaagcaaactcattaagcatggattaatttgattcaacccttgcgtggatattaattaaggacctttgacaggagagggtcctcaaggttcctcaaagagtaacttatcatcaaggaaggtgaagaatggatggatggcttgggcccaagactggggctattcacttgtggggaaacccatgtgaacccagttaccccatactttgggaataatgactgagcatgactataatctttaagaagctcaaatgcggaatacctctgaggcttatgcaaggatctggcctagcatcaaggacaaaggctcagaggactccttggggccagttttctacagtcataccatcagccacaacagcagcaaaggcagaaggaaaacagggcccaggagtggctgacgactgcctggagtccaactggtctcctggagttcataagaggtttgaccccttctgagctgaatgtgtcctgatttaggggatagctagggcaataagaaagcctcagggggtgctactgatctggaactcctactaattagtgtgtatgtatgtggccaccagtggttagcagatgaggtgaaagagatgggacagtgactgtatctgttctgatgaaggagattgtgcagttacatgcgtaacgtcattaaacttcattcttccaggt

SEQ ID NO: 13547 - DNA, 876 bp, Homo sapiens
gaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtatagaggccgaagaccaagaactgcttttactcaaaaccagattgaagtgttagaaaatgtctttagagtaaactgctatcctggtatcgatattagagaagacttagctcaaaaattgaatctagaggaagacagaatccagatttggtttcaaaatcggcgtgcaaaactgaaaaggtcccatagagaatcacagtttctaatggcgaaaaaaaatttcaacacaaatctgctggaatagatagaaaactaaacaagtgaaattatcttctaattgcagagcatgaagaatcagtggaaatattaagtgttaaaatgtgatgttttctttcctgcatttaatctgaatattgtcattttttctgaaaatatattgtaaatactattatagcatggtacatatttgggcacttttagttatagtaaagaccttttatatatattttaataaacattttcagaaaagattgctattttttaagtaagccaaattaatctaataaattagtttgttaaaatcaa

SEQ ID NO: 13548 - DNA, 657 bp, Homo sapiens
tttttagtgttacaatctttaaaagttttccccttagattgtttatcagccagtctctctctcccgaagagttctttagtttttgaggaagttgatttggaggcagttcttacaatgagttaagggttcccagttgtgttacagtttctttttccttgatatctcatttctactctgccaacaagaacaccatgcaccccagctctaaagaaggaagactttcaagcccccttgtcagcggagctataaggtgaactgcaggaagatcccagccctatacacgtggggcagagccagcagaggccagagctgttgctctgtgcagaccacgagaggatgtctcccagccttcaggaaggcgctcagctcggggaaaacaaaccctcaacttgctccttttcaattgagagaatcttaggactggaccagaagaaagactgtgttccattaatgaaaccccacaggccctgggcagacacctgcagctcatcagggaaagatggtaacttatgtctacatgtcccaaatcctcccagtgggatttcattccctagcgtggtggatcacccaatgccagaagaaagagcttcgaaatatgaaaattacttttcagcctcagaaagactgtctttgaaaagagagttgagttggtataga

SEQ ID NO: 13549 - DNA, 3781 bp, Homo sapiens
ccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgcta

SEQ ID NO: 13550 - DNA, 1120 bp, Homo sapiens
gatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 13551 - DNA, 2096 bp, Homo sapiens
ggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacagcgggaacttcattgcaggccgtgtgtcaccctgaccacgtctatctctgggggtcgcacgttgcgggcagagcgcaaggcatacaccagaaaacgctgtcctgtggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtg

SEQ ID NO: 13552 - DNA, 2629 bp, Homo sapiens
gcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaa

SEQ ID NO: 13553 - DNA, 2694 bp, Homo sapiens
gtctcagtccatcaggggggggagggggtggcgcgcgcgccatttctagtcgttttcaaagcgcctcgcgctgattctcacgggcccggctgccggcccccgctctgccctgcagcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaaca

SEQ ID NO: 13554 - DNA, 2691 bp, Homo sapiens
caggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacaggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacatta

SEQ ID NO: 13555 - DNA, 1699 bp, Homo sapiens
tttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggagtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttc

SEQ ID NO: 13556 - DNA, 2107 bp, Homo sapiens
atttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgct

SEQ ID NO: 13557 - DNA, 2952 bp, Homo sapiens
gttttccgtttgggttggggagggtctcgaaaatggggatcctagggtacggagctccgtgggcttggcggtcgtgctagcccagcgtgtgggctggggggtggggagccgtgtttccagggtggggaaggaatgtccaggtgtgcggggctgcgagagttctgaggaaggaggatcctggaatatgccgctggatgcgatcctgggcgttctcctatttggatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggatt

SEQ ID NO: 13558 - DNA, 1018 bp, Homo sapiens
ctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaactt

SEQ ID NO: 13559 - DNA, 3714 bp, Homo sapiens
agaacaaatcattgtgggaagctgggaggagagagagagagaggaagtcggacgtgggcgaggggcggggtgtctggactggaacctctgggcccacatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtcta

SEQ ID NO: 13560 - DNA, 3600 bp, Homo sapiens
atggatgtgcgccgtctgaaggtgaacgaacttcgcgaggagctgcagcgccgcggcctggacactcgaggcctcaaggccgagcttgctgagcggctgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaaggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtcta

SEQ ID NO: 13561 - DNA, 4201 bp, Homo sapiens
cagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccactgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtcta

SEQ ID NO: 13562 - DNA, 3596 bp, Homo sapiens
cctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattgggattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 13563 - DNA, 3605 bp, Homo sapiens
gaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 13564 - DNA, 3961 bp, Homo sapiens
aaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 13565 - DNA, 2766 bp, Homo sapiens
atggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaa

SEQ ID NO: 13566 - DNA, 2980 bp, Homo sapiens
gaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgt

SEQ ID NO: 13567 - DNA, 707 bp, Homo sapiens
gttccccagagcattgttcctgagaaggaaaagagtccaaacacctacccacacctgctttgtgccaagaatccacagttggattgcaaggacagtgtatgttgtccttttggaaaaatgagagtgagcccaaatgaagaacaagcaaaggcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagcattgttgatgctcttgagagcatcagccaggacattaatgtgcaccactgtggtggcgtggaaagatggcaaaaagagccctgcatgattttattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagcttt

SEQ ID NO: 13568 - DNA, 1042 bp, Homo sapiens
ccaggttgcatgaggggttgggggtgggatggacagagcactggctgggcatcaggactaggctggagtcctggctcaaaactctaccacaacctgacactgggcaagatggcccacctgtggcatcccaggttcctgccctgtaaagaggagtctgggtgtatatccagatggactgtgagcacagcctgagtttgccctgtcgaggtgctgaggcctgggagattgggattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagct

SEQ ID NO: 13569 - DNA, 3992 bp, Homo sapiens
atctatcttgctgtgtttggacaggccagcccctgaaacatcttgggcaatggagggttaacttctcaaagtttaataggcaagaccagcaaccatgcaacaagaagatactctataaatgatgattcaatgaatgccaagccctgttctatgcactgaagaccaaaagaaataaaagacatcattcctgctctgacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcgagacagggtcttgctatgttgcccaggctgttcttaaatccctggcgtcaagtgatcctcctgcctcagcctcctaaagtgctgggattacaggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 13570 - DNA, 739 bp, Homo sapiens
agaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggaga

SEQ ID NO: 13571 - DNA, 5772 bp, Homo sapiens
cggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaa

SEQ ID NO: 13572 - DNA, 5278 bp, Homo sapiens
acccgggaaggagtaggaaaggggcagaggaactccgcccgccgcgccccctccccggaactgtggcgcccggaactgaggctcggcgaggggcgtcccccattaacccccgcccctccaaatcagcctcgggaccgcccagcctcgtgtcctcaggatctgcctctgagttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataatcaaa

SEQ ID NO: 13573 - DNA, 3493 bp, Homo sapiens
aggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaaaaggaacactggaaaataaattttgaatgtttatgttctcagaatcaggttgacagtcccttgctgacatggctttgctttgtgtaaatacagtggatctcaatcttc

SEQ ID NO: 13574 - DNA, 3066 bp, Homo sapiens
gggtgcctcatattgccagacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttcagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgccgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggagaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttattta

SEQ ID NO: 13575 - DNA, 2737 bp, Homo sapiens
atttcacatcacaacgacttgtggttttaatcctccgtttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgaacagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacagaagagcctctcccccatgcatactcatccacctccctcccctagagctattctcctttgggtttcttgctgcttcaattttatacaaccattatttaaatattattaaacacatattgttctctaggc

SEQ ID NO: 13576 - DNA, 1397 bp, Homo sapiens
agccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgctgctggacatcgtctcttcttatggcaagggctatgtggtgtggcaggaggtgtttgataataaagtaaagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttcttt

SEQ ID NO: 13577 - DNA, 1383 bp, Homo sapiens
ctttcaattccagtacgatgtcagctcggccgcgcagcccggctgctcagtcctcgacgaggccttccagcgctatcgtgacctgcttttcggttccgggtcttggccccgtccttacctcacagggaaacggcatacactggagaagaatgtgttggttgtctctgtagtcacacctggatgtaaccagcttcctactttggagtcagtggagaattataccctgaccataaatgatgaccagtgtttactcctctctgagactgtctggggagctctccgaggtctggagacttttagccagcttgtttggaaatctgctgagggcacattctttatcaacaagactgagattgaggactttccccgctttcctcaccggggcttgctgttggatacatctcgccattacctgccactctctagcatcctggacactctggatgtcatggcgtacaataaattgaacgtgttccactggcatctggtagatgatccttccttcccatatgagagcttcacttttccagagctcatgagaaaggggtcctacaaccctgtcacccacatctacacagcacaggatgtgaaggaggtcattgaatacgcacggctccggggtatccgtgtgcttgcagagtttgacactcctggccacactttgtcctggggaccaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggaagtccaacccagagatccaggactttatgaggaagaaaggcttcggtgaggacttcaagcagctggagtccttctacatccagacgtacccctgagcagaaggctctggtgattggtggagaggcttgtatgtggggagaatatgtggacaacacaaacctggtccccaggctctggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaactatttacatagcatttatattgtatta

SEQ ID NO: 13578 - DNA, 1901 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctcttggtgaagatgaccccgaacctgctgcatctcgccccggagaacttctacatcagccacagccccaattccacggcgggcccctcctgcaccctgctggaggaagcgtttcgacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 13579 - DNA, 2021 bp, Homo sapiens
gtatccttagctcggctcctcgcttccccagcggctcgccccagacattgcaccgcggaggggaggccggtcgacctctccggcgatgcccggcttctgcctgctgtgggagggcagcggcgggcaccgtgatctccgcaccgagaagagctccccttgccctctagtcgaagctcccgagtgctcggagcacgctcacccctcgcgaacacacccctgcagccgaagcagcccctgaagcccgcagcgcctgcaacaggtccggggcagtgggggaaacttacagcagtggcgactggccgcaacgcacaactgagttctagcgacggtcacgggcaaggaggcgacgaaccggtcgtctcagcccagggaagcggtggcgaatgccccggagaaaggagggccagccggggagaggactgcgccccgaacgatggctcgcggaccggctaccgatggcgttcgcctccgtctgtcgtccccacgccgcggacccggtgtccaggacccgcagagcgtctccggagcgcgtcacgatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaaggaagctattctttgtctcatgtttatacaccaaatgatgtccgtatggtgattgaatatgccagattacgaggaattcgagtcctgccagaatttgatacccctgggcatacactatcttggggaaaaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttgggaatcaaatccaaaaattcaagatttcatgaggcaaaaaggctttggcacagattttaagaaactagaatctttctacattcaaaaggttttggatattattgcaaccataaacaagggatccattgtctggcaggaggtttttgatgataaagcaaagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtactcagaaacagaaacaacttttcattggtggagaagcttgtctatggggagaatatgtggatgcaactaacctcactccaagattatggcctcgggcaagtgctgttggtgagagactctggagttccaaagatgtcagagatatggatgacgcctatgacagactgacaaggcaccgctgcaggatggtcgaacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 13580 - DNA, 9117 bp, Homo sapiens
tgaggcctgaggcctggggcggggtggcggccgggctggccttggcctcgcgccttcccctgcggccgccgcgggctccgcgggcggtatcggagtgtcgtgcggcgcgtggccgcgtgacacgcgcacttgtcggagtgacgggccctgcggaagaggaggtgcggcccagggcgcaggggagccctcgggagcgggcccggccctcagcgccgccccggccgtgtcccggaggagcggcctgcgccgccgcgcgagaggaagcacccaggcatgtggaatatgctcatagtggcgatgtgcttggcccttctgggctgcctgcaagcccaggagctccagggacatgtctccataatcctgctgggagcaactggggacctggctaagaagtacttatggcagggactgttccagctgtacctggatgaagcggggaggggtcacagttttagcttccatggagctgctctgacagcccccaagcagggtcaagagctcatggccaaggccctggaatccctctcctgccccaaggacatggcacccagtcactgtgcagagcacaaggatcagttcctgcagctgagccagtaccgccaactgaagacggccgaggactatcaggccctgaacaaggacatcgaggcacagctccagcacgcaggcctccgggaggctggcaggatcttctacttctcagtgccacccttcgcctatgaagacattgcccgcaacatcaacagtagctgccggccaggcccgggcgcctggctgcgggttgtccttgagaaaccctttggccatgaccacttctcagcccagcagctggccacagaactcgggacctttttccaggaggaggagatgtaccgggtggaccattacttaggcaagcaggctgtggcgcagatcctgcctttccgagaccagaaccgcaaggctttggacggcctctggaaccggcaccatgtggagcgggtggagatcatcatgaaagagaccgtggatgctgaaggccgcaccagcttctatgaggagtacggtgtcattcgcgacgtcctccagaaccatctgacggaggtcctcaccctcgtggccatggagctgccccacaatgtcagcagtgcggaggctgtgctgcggcacaagcttcaggtcttccaggcgctgcggggcctgcagaggggcagtgccgtcgtgggccagtaccagtcttacagtgagcaggtgcgcagagagctgcagaagccagacagcttccacagcctgacgccgaccttcgcagccgtcctagtgcacattgacaaccttcgctgggagggcgtgcctttcatcctgatgtctggcaaagccttggacgagagagtgggctacgctcggatcttgttcaagaaccaggcctgctgtgtgcagagcgaaaagcactgggccgcggcgcagagccagtgcctgccccggcagctcgtcttccacatcggccatggcgacctgggcagccctgccgtgctggtcagcaggaacctgttcaggccctccctgccctccagctggaaggaaatggagggaccacctgggctccgccttttcggcagccctctgtccgattactacgcctacagccctgtgcgggagcgggacgcccactccgtcctcttatcccatatcttccatggccggaagaatttcttcatcaccacagagaacttgctggcctcctggaacttctggacccctctgctggagagcctggcccataaggccccacgcctctaccctggaggagctgagaatggccgtctgttggactttgagttcagtagcggccggttgttcttttcccagcagcagccggagcagctggtgccagggccagggccggccccaatgcccagtgacttccaggtcctcagggccaagtaccgagagagcccgctggtctccgcctggtccgaggagctgatctctaagctggctaatgacatcgaggccaccgctgtgcgagccgtgcggcgctttggccagttccacctggcactgtcggggggctcgagccccgtggccctgttccagcagctggccacggcgcactatggcttcccctgggcccacacgcacctgtggctggttgacgagcgctgcgtcccactctcagacccggagtccaacttccagggcctgcaggcccacctgctgcagcacgtccggatcccctactacaacatccaccccatgcctgtgcacctgcagcagcggctctgcgccgaggaggaccagggcgcccagatctatgccagggagatctcagccctggtggccaacagcagcttcgacctggtgctgctgggcatgggtgccgacgggcacacagcctccctcttcccacagtcacccactggcctggatggcgagcagctggtcgtgctgaccacgagcccctcccagccacaccgccgcatgagccttagcctgcctctcatcaaccgcgccaagaaggtggcagtcctggtcatgggcaggatgaagcgtgagatcaccacgctggtgagccgggtgggccatgagcccaagaagtggcccatctcgggtgtcctgccgcactccggccagctggtgtggtacatggactacgacgccttcctgggatgagggcgcctgtgccccttgcccgcttcgctcctgtgctttccttcgcccgtgtcttccctcccttctcggccccgccacctgcccagcgtgccctggctctccagaaccttctatcccacagtcaggccccagagagggcaggacaagccttgtcccgatgcctttgaccggcagctctgtgtattggtggatagatgcagaaacaaggaagaaatggagtctgctcctgagaagcttcaaattcaggccaggagagaagtcttaagaaaagacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaaccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggttgaaaccagcctgggcaacatagtgagaccccatctctacaaaaagttttaaaaccaggtatggtggtgccctcctgtggtcccagctactcgggagtctgaggtgggaggatcacctgagcccaggagactgaggctgcagtaaggtgtgattgcactattgctctctagcctggaaaacagagtgagaccctatctcaaaaaaaaaaaaaaaaaaaaaggaaagagtgatgacaacagcccagggagcagccccgctcagaacccaagtcccaagttccagcactgtgttcccaggcaggctgtttgcctcttcctggtctggaagcccttgggtcctatggtggcggcagctcccacagtccaggttccctggtggggaccaatgattccatccgcatggaagcccacgtgtgcacttaggggcccataaatggcagaagggcccctcctttgggagaccttgtcagtcagcatctctagggcaaccgtgattgccatttgtagaggggaaggaatcaagggactttaagctagatcaaaatctggggacaaattctcctgctaactgcaagttaaaataggcccttcttactgaatttccctgtttgtttctctgcagacaatgctttagccctactcttgggcccccaagttagcagagtaatcaaagcttcctaccgtttggcctactattccagactagtccctcgaggggttcccttccaaaatatgcagggctcaggctcccaattccgggcctgtctgctttgcttgtgtttctcctgtccctgttctcccggagggcccaggtggaactcacgacagggagggagacgcttcccaaaaacctgcagggctatttcccagaatttggttttcaagtacaaaactttttgtcctgtaagatatatgcagcctcacagaagcagcctctgcctccactttaccagctacgtttttatcttaagcacatggggctcccttagaacttactccactgatttaaaaaaaaaaaactgcctggcagcatctcagtgtcagagtgagcacggcacaggaaaggcccgtggtgacgagggtgaggtggccacagtgaccggacgacaaatgagactctgcaaatgagactccagagggtgaagatctgcggtctccagacatcataggccatgtgacccactaggggccgcttacccctggccgtccgctggctgaactgaacgcattccctctctccgcaactctcccgtgaggctgcacccgtgtgggtagcactggaagcggcactgtttgcattgtacataggaaggaaggaagttcttccagcctcaccagcacctggcagcgagtcagagcctgtgagggcatccgaagcagtgatgcagtgtcaacctcccagctggtgccactctgccctcgggggctccaagcattgtaactcagtcatgggagctgcctctttggaagtgcagatttattcctgtaataatcctgcctgcttttacctctcgtccactgaccagcaagtgtgagtcccggtgtcagtcggcacagtccagtgtccatctgcatttgctcatgcagagggggtgagttgggcactccctgttgttggttttccttttgcagcacactgggcagtctccctataaaacaaaaaccccaccttctgtgccttctgctttagagcagagctccccctcccatttcctcagtcttccctgcaaaatctgtccaccggggaaggcagcaggaaccctgggcagcgggtgttctgggaaggctagtgacagcagatgtcatccaggaacagccacacacggttctccaggccgccgtcagcagctcaaggtggggtatgagtgagaagctgaggatctcgcagcttgttgctgagcaaggtgcaaccgggctcatgctgtcatcagcacaagacgggatggcaagggctttcagacgcatttccaagagtccagcaagccagggggaagatgatccctttgccgaagtgtaccctctagccaacttttgggagcgcttctgtttgcaaagcgctggggatgtgcctgtctctgtgtgacccacgaacgggaagggagagcactggagtaatgacacttctgctgctgctttgattctcaaggctgatctttaaaaccctcgccttgctgacaggtgctttaaaggcagtctgcatcttttcttcccttggtgtgggagaggtaaacactttgatttgctgaaagctgtatggagtatatttgaacagctagtagttagctttgaaagtggaagtgtgaacagacactacttgtgtcgctttgggtccttcactttacccccacagaagtctagaggcgtctgttataaagcgttacggggcgcctgcatgcaggaggaaggacctgtattagctggaaatcatcaggaacccagcttgcctccatctctctgagatgtgctgggtacagcctgcccctcctagttctgtccaccgggaagagccggctggcggcagatccccaggggcagagcccctgctggatcctgggagctcatctttacctgtgccggagtgggaactgtgattccagccgggcaggtcagagtggagcagtgctaagaggctgttgcaggagaactagacgggcggggcctgctgcatctggatcatgtttctgtgctctgccccgcgctagggactcagggtctgggcttctgccaggtgaggagcagagagactgttcccttgggtggagaggtgtgggcatgagagccacccattgccaagcagcaagaatgttcgtgcttttttccagagaggggaaccccactggtttttgtggaaacaatggaaacttacagatgcctgcctgggatgatgaggcacattcagaacaaatgcttttttttttttgagacagagtctcgctctgacgcccaggctggagtgcagtggcgcgatctcggctcactgcaaactttgcctcccaggttcaagtgattctcctacctcagcctcccgagtagctgggattacaccaccatgcccagcaaatttttgtgtttttagtagagacggagtttcaccatgttggccaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaa

SEQ ID NO: 13581 - DNA, 2148 bp, Homo sapiens
ggcccgcctgacgtgggaggcagccagggttaatcatttccacgaagccttgaccccacctgccttggccgctctgctcccgcctcccactgcccctcaggccagctcaggagccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaag

SEQ ID NO: 13582 - DNA, 4571 bp, Homo sapiens
tttgccaactgcttcctggctcagtgcgacctggccttcttcccctcccccatgcggccggcttccgagtgcgcaagcccagagtcgtccgcgttgtccgcctctgcgcaagcgccgtgctcctcccacggcagttggccatatagaggctgggggtggggggggaggtcaagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaa

SEQ ID NO: 13583 - DNA, 6372 bp, Homo sapiens
aggcgggattgggccgccgccctatatagcagccggggcccgggcgccgcgcctcggagcgtcccggcttctcccgcgcggggggcgagtaagccagcggcaggaccagcgggcgggggcccacgacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgtca

SEQ ID NO: 13584 - DNA, 4489 bp, Homo sapiens
gatcggggggcctctctgggattggctgcgcgcacgtcacgtggggccgacgggccctgcgcagaccatcgagtcgggcgtccctccccggggacgtggccttcctgtgcccgggctggggcccgccgccccgcgggggagggcggagctggcgcggcccctagctttctccttctggtgtggggcccgagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaa

SEQ ID NO: 13585 - DNA, 581 bp, Homo sapiens
aagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgt

SEQ ID NO: 13586 - DNA, 525 bp, Homo sapiens
atatagaggctgggggtggggggggaggtcaagcgtagcctcttctcctttaccaagatggcggcttgtccctgtttcgccacagttcctaccttatgagctcggttttcttatgcttataagagtggaacagacacatgcctcactcctgtcagcagttccaccttttcatggttgaggagcacatgtggtcgccagcctcccatctccagagtcccctaaggcaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaac

SEQ ID NO: 13587 - DNA, 559 bp, Homo sapiens
atatagaggctgggggtggggggggaggtcaagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcatttttggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccga

SEQ ID NO: 13588 - DNA, 578 bp, Homo sapiens
tcggagcgtcccggcttctcccgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcct

SEQ ID NO: 13589 - DNA, 929 bp, Homo sapiens
agaaacttgcctgagtattggtgttagtaaccaaagcataaatatcttgaccttttctgattttgaggtaaaaagatctgagttgtaaaatgtagataagtaacttttctctggtttcctctctctcctctcccacttcccatcccataccagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtgga

SEQ ID NO: 13590 - DNA, 544 bp, Homo sapiens
aagcgtagcctcttctcctttaccaagatggcggcttgtccctgtttcgccacagttcctaccttatgagctcggttttcttatgcttataagagtggaacagacacatgcctcactcctgtcagcagttccaccttttcatggttgaggagcacatgtggtcgccagcctcccatctccagagtcccctaaggcaagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatg

SEQ ID NO: 13591 - DNA, 530 bp, Homo sapiens
gattcaaaaagtatttgagaacctactaggtgctagacaccaaccgaggcaatgagtatgggtgacaacatgtgccctgccctcacagcaccaatagtccactggacaaataccatctggaacatcaggtaaacacctaagcctgtctggaggaaatctaatttgggcggaatcccacaagcacagactagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtg

SEQ ID NO: 13592 - DNA, 594 bp, Homo sapiens
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggaga

SEQ ID NO: 13593 - DNA, 459 bp, Homo sapiens
cgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaaggcaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctgg

SEQ ID NO: 13594 - DNA, 4283 bp, Homo sapiens
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttat

SEQ ID NO: 13595 - DNA, 1096 bp, Homo sapiens
gtcaagcgtagcctcttctcctttaccaagatggcggcttgtccctgtttcgccacagttcctaccttatgagctcggttttcttatgcttataagagtggaacagcagttccaccttttcatggttgaggagcacatgtggtcgccagcctcccatctccagagtcccctaaggcaagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaa

SEQ ID NO: 13596 - DNA, 612 bp, Homo sapiens
acaacagacagccttaggggaaatggggaaactggagaaaagggctcttatcccaaaaggaccagatccattggaacagatagagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaagga

SEQ ID NO: 13597 - DNA, 708 bp, Homo sapiens
ggggacgtggccttcctgtgcccgggctggggcccgccgccccgcgggggagggcggagctggcgcggcccctagctttctccttctggtgtggggcccgaggtcagagcccagcacaacaacccttcttctggttcagccgcccagcggttatgtggggtacgggaaagatgatccagccatgcaggagagcaccagtggttctgtgaggattttacttcaaaatacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctcca

SEQ ID NO: 13598 - DNA, 598 bp, Homo sapiens
ggtggcatctgcgaaagttcctccatgcaggatgggtgccgacttccagaacttgcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactg

SEQ ID NO: 13599 - DNA, 566 bp, Homo sapiens
ctcggagcgtcccggcttctcccgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaaggcaaggtgactcaccctcctacttcacagagttcttggtcctccccagacagcctttgaaggttcctttcaatcctgcgatttcatgacctggtttctagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtg

SEQ ID NO: 13600 - DNA, 996 bp, Homo sapiens
gcttctcccgcgcggggggcgagtaagccagcggcaggaccagcgggcgggggcccacgaacacatgcctcactcctgtcagcagttccaccttttcatggttgaggagcacatgtggtcgccagcctcccatctccagagtcccctaaggcaaggtgactcaccctcctacttcacagagttcttggtcctccccagacagcctttgaaggttcctttcaatcctgcgatttcatgacctggtttctagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgcttt

SEQ ID NO: 13601 - DNA, 420 bp, Homo sapiens
ccgcgcggggggcgagtaagccagcggcaggaccagcgggcgggggcccacgagtcagagcccagcacaacaacccttcttctggttcagccgcccagcggttatgtggggtacgggaaagatgatccagccatgcaggagagcaccagtggttctgtgaggattttacttcaaaatacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccact

SEQ ID NO: 13602 - DNA, 4046 bp, Homo sapiens
aaacctccacgaaaataaggctcaccttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattca

SEQ ID NO: 13603 - DNA, 4112 bp, Homo sapiens
accttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcagagtctctacaaggaagataacggactgtaaaattctataaagcaaagctacacatcacttgacaccatacaccatcttggttacataatgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgttacatgaaggaactggaacagtatcagaaaacagaggcctacaaggtcttcagtaggaaaacccaggaccgtcagaaaggcaaatctcataggcaagatgcagcccggcaggccactcatgatcatgagaaagaaacagaggtaaaggaacggtctgtttttgacatccctatatttacagaggaattcttgaaccatagcaaagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggaagtggagagacacctacagtggacaccattgactcatatatgaacagactgcacagtattattttagctaatccccaagacaatgaaaacttcatagctacagttcgagaagttgtgaacagactcgatcgttagggaatggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaa

SEQ ID NO: 13604 - DNA, 558 bp, Homo sapiens
aagcaaggcgagcttgggggtggccccagtcgagatgcccttcaccccttgaagatcacccctcttttggtggtggtggtactgagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcaga

SEQ ID NO: 13605 - DNA, 631 bp, Homo sapiens
gacaaggggcggggctgccgagaccttgggcccgcgtgagggaaaatttgggttcgattaagccgcagaggaaaagaccaggggagtctgggcccatttgggcgtcggggcccgctaggtcagccgtcatcgaatacagaatatgttttcgaggacgctaatatgtagtcatgaccaatttcagttcttctactttctgcgggccttcgcaataaaaaaaaaaaaactacatctcccagaaacctccacgaaaataaggctcaccttgcgtaaccacgtagtccttcgccgcattggggcaaaataatcccttcatttttgtgaagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagca

SEQ ID NO: 13606 - DNA, 559 bp, Homo sapiens
aaggttaaaaggcccatttaccatacagtttaaattgatgtgtccaagtcaagaaaataaatatttagagagatggaaaacttgatgactagctccaccctaccgcccctttttgcagatgaagacggttccaaggagagtaatgatctggctaccactgggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacagcgctaccttgatgaagcagacagagataaggagcgtt

SEQ ID NO: 13607 - DNA, 1596 bp, Homo sapiens
gcgggcggttggttggagcgtcgcgcagtcgggaggtccgggaaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaagcttg

SEQ ID NO: 13608 - DNA, 1460 bp, Homo sapiens
aaagtttctttggaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgctgaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccacccgggcctggtcccatcctgcaccttgggggctccagcccccctaaaattaaatttctgcagcatccctttagctttcaatctccccagccccctgaacccggaaaaagcactcgcgatacacccagaagaacctcacagccgagggtgcccctcctcggaggacagacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgtttt

SEQ ID NO: 13609 - DNA, 711 bp, Homo sapiens
cgcgactcagcaacctccccaaccaatcgccggccggcgcgccgatcggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggag

SEQ ID NO: 13610 - DNA, 759 bp, Homo sapiens
gggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtccggcccggagcggccatgtcccacggccccaagcagcccggcgcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcc

SEQ ID NO: 13611 - DNA, 1992 bp, Homo sapiens
catttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 13612 - DNA, 1948 bp, Homo sapiens
ctttttaagctcccctgagccggtgctgcgctcctctaattgggactccgagccggggctatttctggcgctggcgcggctccaagaaggccgcgagttgtgcacccggcggagcccggaggagcccggcgcacctcgcgcggcggccgctcccgctggagccggagcccgagcccgagcccgggcccgggtgaggggcggggagagacacgggctgcggcgcggcaggagagtggggggtcgggcgccccccgcagctcagggaacatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgga

SEQ ID NO: 13613 - DNA, 1773 bp, Homo sapiens
ctttttaagctcccctgagccggtgctgcgctcctctaattgggactccgagccggggctatttctggcgctggcgcggctccaagaaggccatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgga

SEQ ID NO: 13614 - DNA, 1981 bp, Homo sapiens
ctttttaagctcccctgagccggtgctgcgctcctctaattgggactccgagccggggctatttctggcgctggcgcggctccaagaaggccgcgagttgtgcacccggcggagcccggaggagcccggcgcacctcgcgcggcggccgctcccgctggagccggagcccgagcccgagcccgggcccgggtgaggggcggggagagacacgggctgcggcgcggcaggagagtggggggtcgggcgccccccgcagctcagggaacatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgga

SEQ ID NO: 13615 - DNA, 1848 bp, Homo sapiens
ggtccccagcagcaagaggtggggggaggcaccagatggtatgagagcttccagggagacccgccaagatctccaggcaggccgggccaggctctctgggattccggactggcttcgcccaactggaaccccctcgatgagggggccccaggcagaccttatatgagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 13616 - DNA, 1726 bp, Homo sapiens
aagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgta

SEQ ID NO: 13617 - DNA, 1959 bp, Homo sapiens
catttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgcggctccaagaaggcatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 13618 - DNA, 2159 bp, Homo sapiens
ctttttaagctcccctgagccggtgctgcgctcctctaattgggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccaccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctgg

SEQ ID NO: 13619 - DNA, 1529 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatgggacaatctactaccaagaaccagctccaagaagaaaacatctctgggaaacagtaccaaaaggagtcactgaattgtcattggaggagtccaggatagctcttcatgttattttcaccttgaggaattgtccattacatctatgagccttatgtgtggctttctccgatatagaaacctatcaggtgtcttttagatcatttcaaaacactggcttattctttcttatgtttccaactgaagtctgcatcccaagatgtagtttcactgctaccccatatggcacccttgtacgaatttgaaaaaagtactcactctaggcacatgcagagccatgcctgcggggacagcttagagagtagagggtgggctgaactccagttactctcgtacagggatccacctttttgcagaaatcacagtgtggctatggtgtggtttgatttcataaaacagatgcttaaaaagta

SEQ ID NO: 13620 - DNA, 611 bp, Homo sapiens
agcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaa

SEQ ID NO: 13621 - DNA, 1398 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatgggaggagttttacattgcagcttagaagcctttcttccaatagcagagatttggtgtcatgtggtgttcatcagtttgaaaagaagtatttctgctgtttgcctcaagatgtacatacagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacctcatgtataaaa

SEQ ID NO: 13622 - DNA, 4473 bp, Homo sapiens
cagcccgggatccccggcctgtccctttaaccccgccgccgggcgggagcacgtgagcggggctccgggtggcacccgggcgccgccgccgccgaggcagttgtatttcgaacgctgcctctggctagcagccaggcgccttggctcggcggtccgcctggcctccctcctcctcatacttttcttcctgcgcaaccccctcccctttatccgcccacgattagaggtgggcactccccccaccaccaccccctccccaagcgcaagcgcgtgcacgcacacacaccacacacactcacactcacacacactcacacacactcatcccacttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatcaa

SEQ ID NO: 13623 - DNA, 1444 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccggtaggtcccggagtatgtttccatgctgcagaaggcatggagagattccaattgcgggggttcctccgtagcctttgcagctgaacgtctccatctcctgtccctgggcggtcagtcgctggcatggctctgtggagttttacctcccagttgtctatcaccaaagctgtccaccttgtccggaggggaatgagcgtggaaacccctggcggctgtactgacaaaagcaaccttag

SEQ ID NO: 13624 - DNA, 1508 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggttaagagctcaggctctggattcagatggcttgggttcaaattctggtccgtcacttagctaactggagtcttaagaaaatcacatgacctttaaaggtccagtttcctcatctgcaaaaggaggagttttacattgcagcttagaagcctttcttccaatagcagagatttggtgtcatgtggtgttcatcagtttgaaaagaagtatttctgctgtttgcctcaagatgtacatacagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacct

SEQ ID NO: 13625 - DNA, 1527 bp, Homo sapiens
cttgaatcttggggcaggaactcagaaaacttccagcccgggcagcgcgcgcttggtgcaagactcaggagctagcagcccgtccccctccgactctccggtgccgccgctgcctgctcccgccaccctaggaggcgcggtgccacccactactctgtcctctgcctgtgctccgtgcccgaccctatcccggcggagtctccccatcctcctttgctttccgactgcccaaggcactttcaatctcaatctcttctctctctctctctctctctctctctctctctctctctctctctctctctctctcgcagggtggggggaagaggaggaggaattctttccccgcctaacatttcaagggacacaattcactccaagtctcttccctttccaagccgcttccgaagtgctcccggtgcccgcaactcctgatcccaacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggctacagaactaattactgtgaaaagacataaaggaatgagaagaccaaaaccgtatcctcatgatactgacaaatcagttggactgagcacacatgaatcaactgaagaacacttctgccaagttcaagttgtgtaaaagtggaggatatgagtcttgtggggacacagagttgaggcatgagctattagtcagagccgtaaggctgcctgcaggagaagaactttggatggagttttgaaggaagtgaggaaaagatctgaattaacgtattaacacataaagcttgtcatctgaacaggactataagcatctcgaggtggttgctaatgaagagcccgtgctggtgaaggaagcctgctgatcccggaactggccttgcgcgcaagtggtgggatgacagacacattcccttccttgaactgcactcttttcccttgcactcagaggtggcccgagagagccccg

SEQ ID NO: 13626 - DNA, 8094 bp, Homo sapiens
caacccgcgagaggagcctctgcgacctcaaagcctctcttccttctccctcgcttccctcctcctcttgctacctccacctccaccgccacctccacctccggcacccacccaccgccgccgccgccaccggcagcgcctcctcctctcctcctcctcctcccctcttctctttttggcagccgctggacgtccggtgttgatggtggcagcggcggcagcctaagcaacagcagccctcgcagcccgccagctcgcgctcgccccgccggcgtccccagccctatcacctcatctcccgaaaggtgctgggcagctccggggcggtcgaggcgaagcggctgcagcggcggtagcggcggcgggaggcaggatgagcgcacgcggtgagggcgcggggcagccgtccacttcagcccagggacaacctgccgccccagcgcctcagaagagaggacgcggccgccccaggaagcagcagcaagaaccaaccggtgagccctctcctaagagacccaggggaagacccaaaggcagcaaaaacaagagtccctctaaagcagctcaaaagaaagcagaagccactggagaaaaacggccaagaggcagacctaggaaatggccacaacaagttgttcagaagaagcctgctcaggtaagacatagtcattaatttttttctcccaattaatataaaaagtgaaatatgtactgaaaaatgtccccaaactaaaccttatttcgcattttcttacttttggttatcgtcctgcagtattcctgaaaatgtgttgtagccttcaaagttaggaatatatagtctgcaatcgtaccatgaaaacctcccaaaatgtaaggtcttaagtgtacaaagcaaatataaattcttttaaaaataaaactattttattacattgcctcatatgtaaaacaaatatttaatcttatcctatattttaccaattcttaaacatcaaattttgtccttccaactgactgtctatattctgttgacaccagacttatatttaatgattcatgactggaaacatatttcttcattgaacaatttcataatatttgatgatcccaaaacactccaaagaatgctagaatacttggaaattaagttatactaacgtgcagactgatgcattcttagatcttatttaaataactgaatcacagtctctgaagtttttggcaacatcaaattggaaaatagctctacgtctcttgccccatattcctggagcaccttgtcctcactataatctgtacatagaaacattaaaaaaacatatttattgaggaagcatatcttgaagaaaacaaaactgaagtataaattaaccaggattgctaataatgtgagccagtattaaagtataagaacgtcctgctgttctcttcccttctgtatgtaaatagtcattggagatccaggtggtatcatgctgaacctgctaaaataagtagtaagcagtgtcatgagctatcaaattaagtagaactctttcatgtaattttaagtatccatgaaatttttttccctagaagtctttacaaatctaccttgcatcctgttttcttaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaatcattttcattgctgctcccatacctaaaagctaagagtgggagaggggtgctaaaaaaaacccagtgtttgtgcgtctttaagcaatatttaaaaatatatacatataaacaaaaacttgacattttcattaggagaacccaaatatatttagcctctcatcctttaactgtacaaaaatcaagagaaagtaaattgataattctgtgcatttgagtcaaaggatgaggcagagttcacatttgcatcacaggctgtgaactatagattaatcactttatgtggtttgttaatattgattcagcccttgtgcttagtgtcatagggaagatgagtcaaacaaagaaaaacagtcactgcatctgagaaatgtatttatatgtatatgcctgtgtcctatccagtggtatgctggaaccagcccttgtgagcaaatagtgaacatctcttctgaattctgtgttcagtgatgtcaagtaggtagcttgaaatccactatggtgggagtatttacaccatggaaagtgacaaatactacaaatcaggacttttttttttcctgaggagcaagtagttaaacatttacctccccagcatggccccacccttcagcgattctgtttatttggtctggagatccatcatattttttatgaactccctaagtgagtttaatatgcaactagagatgaagacactccatgaaaacacatgagaagatgtctgaacatttgttgagcaaatgaccacagaatgtcaatgtgtatgggacacacgggggatacagatgaatgagtggaatgcctcaggttatcaaggggatgataagactggaattttcttgttttgtttgattttgttgttgttgagttgcagaagggaaaactgaaacataaattaagggaaagaaattacagatgagatgaatggcatatagaaaggtagagaggcaagaacaaatacatcataggtggagattattaatatggctagaactgattgcaagttggacattaatacatcaagaaataatataagtgaaatcacagttgtttttcccaagagaattcagaatctcaaagaagccacaagtggattgagttgatcttcaaggatcaatctggctatcttacagaccctgttccagatttgccctttataggagagttcagactcagaattataaaaaagaacatgagctcattgggctacctaatttatattgtgtaatgacacagtgatgaattatataaacatgaaaactacgtgaaagttcgtggaggataatgtaaattttacactacattcaaaagaatctcttccttttccatctgtttctttcaaaataccctcccagatggctttcccatgaggcaatctggattaactcagcctcatatccttccttcaacagcactttgaggggttacattcagaatcgcttttgaggtggtaaaaattttagcacaactaaatattttacatctaaagaaaagggctcagcagtgtgtaaacagacctacgtttttctttctggccccatcactgggctaattaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaattttttagctggaggaaattttctagtaattgctccatcctactgttagggctaaagcattcagaatcatcttcctagcatttatgtcacacgtatacagaattacaaaggctctgtggtgaagtatcctcatactgcccaatgctgaagtctcctcagaacttcaagaatggcccttgttgaacctggggtacaaagcagcagagtttattctgaggagacaaattcagaattatgataaatctcagcacctgcatacgcacttgtgtttgtgtatacaagtacatgcatctagagagaaatgaaaagtgaaggaccaccctgttgcaggggtttgtgtttgcgaaatccaccaggtgtcatcagctgcaaacatcaagtgtgtcccataatcctaatgggagagttaatagtctcttaaaaatctaaaggggaaaatctgtaatatgtacgttaacttttttctaaaattccaaaaccaatgaaaacagcttacaaaataactctactatatttccacttcaagtgataaacaataaattgaaatcagctaattacaaataaatagaaatgaggctgggtgcagtggctcacacctgtaatcccaacactttgggaggtcaggagttcgagaccagcctggccaacatggtgaagccccatctctactaaatacacaaaaattagccgggcgtggcggcggccatctataatcccagctactcgggaggctgaggcaggagaatcacttgaacctggttggcgggggagggttgccgtgagcagagattgtgccactgcaccccagcctgggtgacagcgagactccatctcaaaagaaagaaagaaagaaatagaaagcagctcgttttttagcaatttgagcagttgaattctcagtcatatgaattacattcttcagtaggaaatggtggtaggtttttctttttctttttttaaaaaaagaaacaccataaaagtaccagattattattattattagagggtgctttgttactcaagtttttactttgataaaaataagtgtctctccaactgagatgtctaaaaaagtttcgctagtttatcaggtatttgatcgtttattgctatttcccttttaaggctttaatctgagacttgaagggactccctaaatgtaattcagacatttttctctcacctttcttctacccaaagggaaaacaggtttttaaaatcctaacagctctccaccctttcaatccactttccccattgttgtacagccctggcaaacgatgcctctggcaattaggacaggtataaacctgctccttttcaatttcccaatgagagaattgcaaagttttcagtttctaaaagactggaaacaaagctttctgtttcaaaaaaagagtttttacttgcaagtaacatcttctgtgggtggtgtgcacccgggcaaagaaatctcagtaagccttgattatcacgggatttcttccccctcaaaataaaatgttgaatgtttttacagagacttcaagggcagttttaaggatgtttatatttcagacaacctaaacattgtttggagcaaaatgagagatttcattttgggacaagcaagttgatgaattgcagtcagcatctcgttctcaaagaaggcatttttactgggggcttttagtctagacatacaaagagggaaggaggaaaggggaaagcattctcactctaacactcgtcttttacatggtaccttggccagtgcagtaaatagttcataataaatcagacttacaaatactcactcgtctactcactcaaggagcataatgatttatactgcctaagtcacaaagattaccgatgtatttattttcttgcttatgcactttcaagctagtaaaacatcttgtgggccagtaaatgtttagtaccaactggcaaaacatgaagaatcatatcaaaggttgccctaagttgcacggttttgttgtataggaaatactttttgacttaacctctgacctctgacatcaccaaggtcaagggaaaaggagagagcaaagtagaaaccaaggtttaacccttaataaagtagctcaaggacatagaagcacagggaaattggagggcagaggaagcgtatcaaaatgattattaactgtaaacagatgaagtaattagcttagctaacagttgtaatacaggaatattggcaggatgaagtcagcggttcttggcaggaaatgttttatagagatgacaacttctaacagaagtgaaagaacatcaatcaatttagggcaacttataaaactccaaaaagcaaaatttagtgtttctggacttgacaaatttgctgtgagagttttttttttaagtatgactgtttctgtgtggggaagtctgtggattaggctcaaaacaaaatggcagtggctgcctgcatttcctcttcatattgcagaattttcctctacattttgatgtgtactggataaaaaccaattgtttactcaatatataatctttcttcttactctccaaacttgctgacccaaattaatgtggaacaaatagcaactggctttaaaacctggtctttctaagaaaatccttaatggttgcatagaaatatgttgcattgcctcagacacttacattcaggaaatgtttgctggacactcagatgtctacagagaaattgttaacttactgttattgatatttttataatcttactcaaaagtcataactcaggataatgaaaaatgtttggtgcaataatgattaaaatccacaaatattctgttccctggccgcaaatacaacacctatgcaaaattttacacatctacaaaacaaagggaaaaggtttttcctagtctatgccattaataagcacatctggaatataacccttaagcagtctttaatcataatttaaagctactttgcataaaaataagaacattccacaacagctgtggaaacattgaaataaattttcttcttctgggccgggcacggtggctcatgcctgttatcccagcactttgggaggcccaggcagaagtattccttgagcccaggagtttgagaccagcctgagcaacatagtgagaccccatctctatttaaaaaaaaaaaaaattaccttcttttgaatactttgtttatgcaaaaatccttttgctttctttagctatttttttaaatgcagtgttcctgcagtaagaattgaacctggcatggaaaactgatcaaaccggtagtcctcagaaatcatcactcctgaaacttgcaattagtttatacctaaaatgatttccctatttgaaaaatgtgcctaccatttccagattttaaaaaaatggccctttatcccagaaaggagaaattcattgtatcccagagaccagcattacttctgttgcagtattttcagtgatggaactctgttgaggctacagacaagaaaagcaggagagcattttaggaatctaagattttttattttactttcctctggggaccttctttaatagtttttttctttcttaagaacctatccttgaatcataggtaaagaaataatcacagaatgagtaactgacattaataatcacagcttcacactatagtcttactggatttttacgtttttcagggtttccccaagtggtggtcacatttcttacacaactctgcagtgtagatagacatgtatagtcattactgggctgacacggtgggactgagacctgctagtgccgtggttggcatctatgattagtgaggtccaagatcaaccttctttacattaaacatgccctagcaagaccttcaacccaactttattaagctgatgctaacgcacacaaagaagtcctaacaattctatgtttttatatacataatgcaaaaataaagacaagatcaggtacaattgctgtcaatatctcaacttattgtctccttttgaaaaacataattcccgcctagcatttccaccagaatcccttgctcttgccaggttatattgtttatatatgttccatttaacatgttttttaaaaatctgctgtagagttttcctagttggaggaaataatcactttccattaagttaaacagtcccgataaattttaaatgaaaatatctgacagagaaatagaaaaactcagccttgtggtcttgccggtcacttagctacagatggaacttgaaaaactggttcctggtcattgctgctgaagagagccctttatttctgttgtgacaggactgactcaagatactcatgaacgtggaaaactcctaaatgtgtcattctgagttcctgagaagttgaacatacacagatgacaaaaaagaatgccatttagccataactaccctttctagattaccaagtatttgtaggtttattggcaagatagcttaaattacgtatgtatttctggcctgcaacatcatgtaatagaagagttgcagaattctttgcagttaag

SEQ ID NO: 13627 - DNA, 821 bp, Homo sapiens
gtaatgttacagagcggagagagtgaggaggctgcgtctggctcccgctctcacagccattgcagtacattgagctccatagagacagcaccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaagttctagttatttctggagttgctgtggatctacagatacgtgatattttggtataactagaatcttgatttctttcataaagttctgccatgttctatttctttccttaatgtttttttcttccctactgttttatcctccctttgctttggaaggatattgctgcatatcgagctaaaggaaagcctgatgc

SEQ ID NO: 13628 - DNA, 2319 bp, Homo sapiens
atctcagggccaaaccgataggaaacgaggctgcctcgcggtggcaccgccaccccccaaccgggttccgagcaccggagctggctgctgctccctctttggagcaaagttttatgcaaagagggtgttttttgaaactttcggtgcacgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 13629 - DNA, 2339 bp, Homo sapiens
gccaataggagccgcgctggctggagagtaatgttacagagcggagagagtgaggaggctgcgtctggctcccgctctcacagccattgcagtacattgagctccatagagacagcaccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaa

SEQ ID NO: 13630 - DNA, 455 bp, Homo sapiens
agaagccctgcctttccagagacctaaagtgtaacgcaatcagagacctttgaggggctcgaggctcggcggcttccgcccctcagcaccagcagagaccccagttttcaggggacatgatcccatagtgtcgccctcacttttgaaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggc

SEQ ID NO: 13631 - DNA, 1727 bp, Homo sapiens
ggttccgagcaccggagctggctgctgctccctctttggagcaaagttttatgcaaagagggtgttttttgaaactttcggtgcacggtgattttttttttttaaggtcccataattaggaagagtcgactcgcttaggcccttgtttattccctatctagtgcaaagccacgaattggcagcatgttttctgacctttggtttggttggtttaaaatggtgttctagattttaaaatcgtttaagtgaccagttagatactcattcagagcagactcgggcggatagatagggaatactgtatgggtatatctttgtgtctagactttttgagatcgccctgaaggactgtttttgttttgttttgtttgcttggcatagccccttcaaggaatttaatctctcggccatattcttgtctgattttacggaggttgatgtcgctactgtgttaaataaccagtactttggttttcattcccttactaagtactttaaggtcttatatgtcataattttattgctaacatcaaatatttattttattttttagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaagttctagttatttctggagttgctgtggatctacagatacgtgatattttggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttatta

SEQ ID NO: 13632 - DNA, 1282 bp, Homo sapiens
gcagtgcgggcccggccggcctcggcccggtcgcggcggcggcggcggccgggcggcggggggagcggcgccgctgcgctcgctggaacatggctgactcgggcccggcgctgctggctggagagaaaacaaggcgggcgggcgggggagctgggcgcagcagttccgagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaa

SEQ ID NO: 13633 - DNA, 4199 bp, Homo sapiens
tttctgcggagggattacgctgacgaaagagacctgcttgcgcgtcgctgttccgtggtccgcgcgagcgtggtcgggagccgctggttcctggggtgacccgcggaggtgggagagggaagggcttccgaagccggcgggggtgccatggaccctctccgccggcgcggccttcacagctgggccgcgccgggcatccgtagtccgctctcccaaagcctcggtggagctgaagctgccacagagtgcatgttcacaaagggtcatcacacacggagctgcccctccctgtctccctagagcccatcttcgaggccaggggcttttctaccaggattctggggtgtttctcctcctttcctccctcccagatcttctcacggtaaggggagcagcgaaagcgcagggactttgcattccacgacccgttctgactagtcaacagccgatctgtccctgctgctctaattccagctgccctgccttgttttaacttcagagaaagggggagttctcatttgataagtttaagcctttgctttcgtaggaaggtcatgtggcttaagggacatcgtgaccgcgtatgctatttctgcctgtgcattctaaatcttgggggcagcatattccagaagtccttttggtcgattggttctgtgtcctaggataacaatttgtagtttctgaccatttctttacagaaaaaccacaattggtattttggactgcggggttttttagtggtctcaaactaaatgattatattctggaataatgctgacaatttggatagggtggtgtggaggaaacaagtctcgtgtagaagaaattatttagtaaaaaggattttagtttttggtacttctgaatgcaaatggccaaggaatccagcagtttgttggggtttctccagacaaaaataggctgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatatgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacatccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggttttaaatactagttaaatggctttcacttaagaacttaagattttgttacatatttttaaatcttgtttctaataatacctcttagcagtaccttttaaataagtataagggatggcaaagtttttccctttaaaaatactcactttatgcttataaataggttaatgggctgataaaaggttttgtcaaacattgcaagtattcggtgctatatataaaggaggaaaaactagttttactttcagaatgatttaaacaagatttttaaaaacaagatacatgcaagcgaacagcagggttagtgataggctgcaattgtgtcgaacatcagattttttgttaagaggagcaaatgactcaatctgatttagatggaagtttctactgtatagaaatcaccattaatcaccaacattaataattctgatccatttaaaatgaattctggctcaaggagaatttgtaactttagtaggtacgtcatgacaactaccatttttttaagatgttgagaatgggaacagtttttttagggtttattcttgaccacagatcttaagaaaatggacaaaacccctcttcaatctgaagattagtatggtttggtgttctaacagtatcccctagaagttggatgtctaaaactcaagtaaatggaagtgggaggcaatttagataagtgtaaagccttgtaactgaagatgattttttttagaaagtgtatagaaactattttaatgccaagatagttacagtgctgtggggtttaaagactttgttgacatcaagaaaagactaaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctgtatttattaattttcttaaagtgaaatctgaaaaatgaaatttgtgtgtcctgtgtacccgaggggtaatgattaaatgataaagat

SEQ ID NO: 13634 - DNA, 644 bp, Homo sapiens
atctcagggccaaaccgataggaaacgaggctgcctcgcggtggcaccgccaccccccaaccgggttccgagcaccggagctggctgctgctccctctttggagcaaagttttatgcaaagagggtgttttttgaaactttcgaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagatattgctgcatatcgagctaaaggaaagcctgatgcagcaaaaaaggg

SEQ ID NO: 13635 - DNA, 1889 bp, Homo sapiens
cgggacgcgggaacggttccctcccggccccccgcgccctttccgaggttccctgccttgacttccccgagttctacgacaacctcagcgacagcgggaggagctgggcaatcggttttgcagggcaaactccaggctctcctcatttattattctctgggcggcgcacgggagaccctgcagggcaacagagcagagcgactacagctcccaggagccaacgctgcagggctgagccgacgcgggggacagacaggacctaaatggtggtcggaggaagggcaaggcagacctcttctgttaccttagcgccagcaaaccgagccgccgccgtcgccaagccaggagaccaacccccagtctcccgactaagtatttttaaatctggcggggctttccttcccgagccaaccactcccaccgtttacagccccaaccagtcagcgtgaggcccgccatttttcaaaccctcttcccgccgccaatcaggatcgagcagtacattcctctcctgaccggttctaacgggtctgggagttaacgacctgggcgacccaccgaacctgctaggctggggcgtggagggcgggtctggtaagacactgaccaatcgttagcctccgtggcaagggggcggggactatctgggtttgaataatcgtcagaaccaatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttcta

SEQ ID NO: 13636 - DNA, 1032 bp, Homo sapiens
caggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 13637 - DNA, 1175 bp, Homo sapiens
gcaaaacaagaggctgaggattgcgttagagataaaccagttcacgccggagccccgtgagggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatatta

SEQ ID NO: 13638 - DNA, 629 bp, Homo sapiens
tcgggttcgtggacctgcctttccccattccctcagagcctctactcggtctcggcgcagtggctctcggggtctgacccggcgagcggcatttggggtgcgggccggcgagggctgggtctgtggagggccggcgggcagtcggaggaggcggaaactgcccctgaccgggcccggttctgggagttttcaatgtcggtcacgaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctg

SEQ ID NO: 13639 - DNA, 3560 bp, Homo sapiens
aggcggctctcgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 13640 - DNA, 707 bp, Homo sapiens
tttgtagttcagcttcaggccaagtgcttcagctccatataagaggtagctttcttgagagcagagatcgaaatatttcctatgcaaaggatggaaatacttcctgcgcgtaagcgcaatcctttcatcattcgaatcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggagga

SEQ ID NO: 13641 - DNA, 529 bp, Homo sapiens
gtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatg

SEQ ID NO: 13642 - DNA, 812 bp, Homo sapiens
cgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtc

SEQ ID NO: 13643 - DNA, 793 bp, Homo sapiens
cgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggagga

SEQ ID NO: 13644 - DNA, 1191 bp, Homo sapiens
aagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcattgttgtttttgggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatcgttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaa

SEQ ID NO: 13645 - DNA, 831 bp, Homo sapiens
gcaggtcgaagaggccgggctacgtcgtgccctgcgcgtgagcagctgcagaggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 13646 - DNA, 872 bp, Homo sapiens
gcaggtcgaagaggccgggctacgtcgtgccctgcgcgtgagcagctgcagaggcagaggcagcatccagcggcggcgccagcagttccagtccgttgctttactttttgcttcaccgacatagtcattatgccgaagagaaagtctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattggaagctgtgtgtaagattgattcagcattccatgcacttgctttaaaatttagtcctgtgcatactgtggtgtttttactgtgcatatttgaatttttcatgcagtttttctagagcaataatcagtggtgcttttgtacctaggttttatgtgattttaatgaaacatggatagttgtggccacctgctgactatttgtggtttaaaataaaaggtttacttgtctgcagaa

SEQ ID NO: 13647 - DNA, 1672 bp, Homo sapiens
atttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccgtgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaat

SEQ ID NO: 13648 - DNA, 1383 bp, Homo sapiens
gctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaata

SEQ ID NO: 13649 - DNA, 1468 bp, Homo sapiens
gcccgcccctcctgccgcccctgccgcgcgcgccgcagcagcgccgccttccctgcgcagtcggtgtctccgcgtcgctgggtgggacttggctcggcggccatgggcaagcagaacagcaagctgcggcccgagatgttgcaggacctgcgagagaacacagagttctcagagctggagctgcaggagtggtacaagggcttcctcaaggactgccccacaggaatcctcaatgtggatgagttcaagaagatctacgccaacttctttccctatggtgacgcctccaagtttgccgagcacgtcttccgcacctttgacaccaacagcgatggcaccatagactttcgggagttcatcattgcgctgagcgtgacctcgcgcggccgcctggagcagaagctcatgtgggccttcagcatgtatgacctggacggcaacggctacatcagccgggaggagatgctggagatcgtgcaggccatttacaagatggtttcgtccgtgatgaagatgccggaggacgagtcgaccccggaaaagaggactgagaaaatcttccgccaaatggacacaaacaacgacggcaagctgtccttggaggagttcatccgcggggccaaaagcgacccgtccatcgtgcgtctgctgcagtgcgaccccagcagcgcctcccagttctgagaggagccaggttccccttcctccctcccttcaccggccccctcccggctcttagcttccactcccttgtgtgtattctggctgggggccagattggggaagcccttctccccgggtctgccctgtggggggcttccggaaaagggaaccctgcggtacccccaggccaaagcaagtaagcggttagcaccccccaatcccagaggcaacaatagagacacaggctgggttggtctgcccctcagtcaggcccccttacccacccaccagccccaaggcccgacccctcccccaaaggggcagtccccttcttgcaggtctcagcttgcggggtggggggagtcatgcccaggggaggagactttttatctggaggggagagaaggattctaggggtgtggagttggagaaagaggcttccttgagccacccttcccaccccagcccttgctggtccctaggccaagccaccaagtgaaaccttccaggatactagcccgccagctgtgggccccagaaagccagcctgccttttagcacttggatacacacagacccacggagctctctgtgtttggcctctcacacacacacaggcccatagacagatgggcagatgcacccagagccccatgcacagtgtcctgcgtgggaaagagacacggtccccctggctgagcccctgtcctcccctctgtccccccaaccgccccccctgcatgcagccaaatggagcatctctgttctttttaataatttcagaataaagtctcatttcagtgca

SEQ ID NO: 13650 - DNA, 1751 bp, Homo sapiens
cgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggca

SEQ ID NO: 13651 - DNA, 1904 bp, Homo sapiens
agcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagggcatggtctagtggcccagtcaggacgcggaaacactccctggaggttctgacccactccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 13652 - DNA, 586 bp, Homo sapiens
cttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccactccctctcagcctccgcctggtctctgctggagaactcctggaacctttaagccctggctcagccctcagctctgtcccatcccagctgacctctgtgctctgcgcccgagctcctgagcccacgtgtagtcgccgccgccagccgccatgggcaaacagaacagcaagctgcggcccgaggtgctgcaggacctgcgggagaacacggagttcaccgaccacgagctgcaggagtgg

SEQ ID NO: 13653 - DNA, 4053 bp, Homo sapiens
gttgcccgggagccgcctgaggaggagcggcgcaggggatgcggctgtggtggcggcggcggcggccgagcgcgggtggcggctgtggcggcggaggggggcgcgggccggcgatggcgcggcggccctgagggcgcggggcgggcggcggccggagggcgggtggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaa

SEQ ID NO: 13654 - DNA, 3395 bp, Homo sapiens
gatgcggctgtggtggcggcggcggcggccgagcgcgggtggcggctgtggcggcggaggggggcgcgggccggcgatggcgcggcggccctgagggcgcggggcgggcggcggccggagggcgggtggcgcgggaggaagcggcggcggtggctccatggcccgggcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaagggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaa

SEQ ID NO: 13655 - DNA, 3734 bp, Homo sapiens
gcagtgcagccggagcggccgagggggcgtccctctgctcctccgagtccaaatgttcatgtctaggcaaacggccccgatcttctaataaacgcgtccgccccagcctcccccaccagggttggctcgtcccccgcattcgttcgagtccgaagcccggatcgcattccggcgccggcgcggagcccggcgctcgcaagatgcccaatagcgcgctgagggacccggcgctcgcctcagcccggcggcggcggcggccgaacaatgaagctcctgaagccgacctgggtcaaccacaatggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgaacttcccacgttctgctgtttgtcctgctgaacagaatcagtaccttcatcagcggatcactaagtcccactgcaccaggcgctgaggttagagaaataactaagactgcgcccttcacccctgatggcaggataggcaaggttggcaccatcgtcacagcggaccctcatcgatgccttgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactag

SEQ ID NO: 13656 - DNA, 3436 bp, Homo sapiens
cggtcgcccagacatggcggacggcagcggctggcaggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaagtgatatgacggtatcacagatcttgctgacgcagcatggaatcccagtaatgaacctgtccgatgggaaggcgtactgctttaatccgtcactttccacatggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtcaacagtagtgggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagag

SEQ ID NO: 13657 - DNA, 2979 bp, Homo sapiens
gacatggcggacggcagcggctggcagccgccgcgcccctgcgaggcctaccgcgccgagtggaagctctgccgcagcgccaggcacttcctacaccactactacgtccacggcgagcggccggcctgcgaacagtggcagcgcgacctggccagctgccgcgactgggaggagcgccggaacgccgaggcccaggcaagccgattttttcagttgatattcaccctgacgggaccaagttcgcaactggaggacaagggcaggattctgggaaggttgtgatctggaatatgtctccagtcctccaggaggatgacgagaaggatgaaaatattcccaagatgctttgccagatggacaatcacttagcatgtgtgaactgtgtgcggtggtcaaacagtgggatgtatttagcttctgggggagatgacaaactgattatggtgtggaagcgggctacgtacatcggccccagcaccgtgttcggctccagtggtaagcttgccaatgtggagcagtggcggtgtgtctctatcctccggaatcattcaggcgatgtgatggatgtagcatggtctccccacgatgcctggctagcctcatgcagcgtggataacactgtcgtcatctggaatgctgtaaagttcccagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtgaaattcaacccaaaaatcttcaaaaagaagcagaagaatgggagttctgcgaagcctagctgcccgtactgctgctgtgctgttggcagcaaggaccgctcgctttctgtctggctcacatgtctgaaacggccgctggtggtcatccatgaactgtttgacaaatccatcatggatatttcctggactctgaatgggctgggcatcttggtatgctctatggacggctctgtggcattcctcgacttctcccaggatgagcttggcgatcccctgagcgaggaggagaagagccgcattcaccagtccacctatggcaagagcctagccatcatgaccgaggcccagctctccacagccgtcattgagaaccctgagatgctcaagtaccagcgaaggcagcagcagcagcagctggaccagaagagtgctgcgaccagggagatgggctcagccacctcagtcgcaggcgttgtcaacggggagagtcttgaagatatcaggaagaatcttttgaagaaacaagttgagactcggacagcagatggccggagaagaatcacgcctctctgcatagcacagctggacactggggacttctccacggcattctttaacagcatccccctctcgggctccctggcgggcaccatgctctcttctcatagcagtccacagctactgccactggactccagtacccctaactccttcggcgcctcgaagccttgcacagagcctgtggtggctgccagtgccagacctgcaggcgattctgtcaataaagacagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccagtctccagctgccctaaccgcagagaaggaggccatgtgtctgtctgcaccagcacttgcactgaagctgccaattccaagcccccagagagcattcaccctccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctgtgacgtggtgtgtgtcgcctgtgaaaaaaggatgctgtcagtgttctccacctgtggtcgccgtctcctctctcccatcctcctgccatccccgatctctactttgcattgcacaggctcctacgtcatggcgctcaccgctgcagccacactctctgtctgggatgttcacagacaggtggttgtggtgaaagaagagtctctacactccatcctggcaggaacctggtttctgacaagcaggactcactggctcagtgtgcagactttaggagcagcctgccatcccaggacgccatgctgtgctcaggaccgttagccataatccagggccgcacctccaactcgggaaggcaggctgcccggctcttctccgtgcctcatgtggtgcagcaagagaccaccctggcctacctagagaaccaggtggcagcagcactcaccctgcagtccagccacgagtaccgccattggctcctcgtctacgcacggtacctcgtaaacgaagggtttgaataccgacttcgagaaatatgcaaggacttactgggtccggttcactactccactggaagccagtgggagtc

SEQ ID NO: 13658 - DNA, 504 bp, Homo sapiens
ctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaagataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacagagtgagaacctgtctcaaacaagagaaaaaaataaatcaaatgctactcaaaattctca

SEQ ID NO: 13659 - DNA, 3291 bp, Homo sapiens
gactcagtaatgagctctacaagccagcctttgtggcatgttaaattcaaaacaagcttagcatttttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagatgtagcaaattccaatacattattggacttccatttggaatcatatgggatactgctggtcttatcctgtccctcctccaggtagagagaccacaagcaggctcaacataacataagctagaaaaattagatgactgaatttctatggcatattgataataaaattcattccatttgctgattgtctgaaattttctagaatactaataaaatacatactatagattctttattagtgaagtatgcactaatcaatactttgaacacaaagcctgtgttactgatttggccgttttgtgaagaaacatttatctttgtacgttcttctattgtgctttctatctaatttttattaatttgtaagagtaagcacctttagaatattaaaaattaattctttatcacatgttgtcatttcttcccattgtgttttctcttgtaattttatctgtgaattaatagctttttgtttgtctttttgatatactgaagttttctattatattcagccagatttttttttaagtctcggcttctgatacattttaaaagaccttctaaaaccaaggttttagaatactaacattttatcaaaataatattatagttttgctttttttaaaaaatgaaatctttactatgtttgaaatttagataagtataaacagtgagaacaaactgtttcccctcaaaataatagccagatgtataaacaaaatttattgaagaacaaagaaacacaaaactaaacctgttctagcttaaaatgcagcttttaccagatttctaggaattgggtaaatgcaaggttctagaaaaccttcaatgcattttgatactttatagtttcttatgtcactctcaagaactcctataagaccaagagtcatctttggactgtaggatttcaggggggttttgaaaacaaatttgatgtttcttatttttaataataacgctctgttatttttgacataaacagtacatttaataattaataaataaatattttaagtatgtaaataattagtactccctgtcacaaacaaaacaaaagtaaggttttactaaacagctcatgagccctcattctgccagtgaggaagccttcaaccccgtgtgatactcactctttcatgcaatagggcttccatgtaatgttgccgtataatcactttaaaaagttaaacgacccatctcaatcacctagtttatccccagggaatacactggcatagagagcctatttacactaataaactaccaagctttgttgttcataataagtaaaatggacttgcattgctctcttttttggacaacttcatcaatgctttttgaattatatgtttcaacaaatgaaacgacagttatccaatcagattcctgaaaatgaacactgaaccgttaatcatactgatatgtactactgacaaaggaaatctgtgaggcacacatgattgatgggtatggggccatgaagaccttgaagagcttcaccagaagtatggaaatcaagactttacagagtcttttgtataaagcacacgtgcaaaaacaaacaaaattagaactaacaatgctattgaaagatacaaaagaattgcagtccatagattggtgtttgtaaatatggcctttttctcgtccttattaaacccttagtatacaaggataaataaattctcacctgcttaattttagtgcaattgaaacacataagcctttttaaagagagaaattcccatgaaaacctactagtcagcaatgggaagttgtataaattcaagggataaacctatccctgttttcttcctgcactgtatgataataccaaaatttgggacagtcacatactaacttttcagatttgttcttgtgtttcagaaaaaagtgctcagcatgaatttggaatgttgttttatgtattgttgtggatctctcagtgtttaacatggtgccttgcatatggtaaatgctaagtaaagcgggatcaatgaattatttccttctcaaacatttatcttataccttgtgtgttcatattattattataaacagagctcaagaaacccaataaagttatgtgttgccagtgtaaaccttaa

SEQ ID NO: 13660 - DNA, 835 bp, Homo sapiens
gactcagtaatgagctctacaagccagcctttgtggcatgttaaattcaaaacaagcttagcatttttttttttttttttggatagaaactggtgggggtggggaaagaaagagggaactgggaagagaaggaggggaacttaaaccttgcttcctgctctgtctttctcagaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcagattgtctcattcggggaagctccagggttctcaagcggaattcgtgtttcattttgtgtagcacccgtcagaaagacaagccaggcatgaggatccatgatgagcgctcttctgagttgccatttggagctgcccgtttagaaagcaaatctgcatttccctcattcctagtttccttcatcctcttttaagtgtcatcttttccatgaagcctactagatcacacagttgaaaattgcaaagtcttcacaccgcagcttcccctttctttgttgctttggttttctccgtgggacttcccaccatccgtaaaattaggtgtttttgcctgttttattcactgctacgtctccaatggttagaacctgacatttagtgggtgctcaataatatttgttgaagtaatgtataataacttcactttcttgagtaattactatatatcatgaactgtggtaaatta

SEQ ID NO: 13661 - DNA, 1150 bp, Homo sapiens
cagtcttccgttaaagatttcactgctgtagatttctgagagtgctgtgtagctgtcctctttatcctggtgtttgccacttcgaacagtcactttcccacttggaacttacttgtggctttgctgacaaaacaggaaaaaaccaaatatggcatcttccatgaggagcttgttttctgaccacgggaaatatgttgaatctttccggaggtttctcaaccattccacggaacaccagtgcatgcaggaattcatggacaagaagctgccaggcataataggaaggattggagacacaaaatcagaaattaagattctaagcataggcggaggtgcaggtgaaattgatcttcaaattctctccaaagttcaggctcaatacccaggagtttgtatcaacaatgaagttgttgagccaagtgctgaacaaattgccaaatacaaagagcttgtagccaagacatcgaacctcgagaacgtaaagtttgcttggcataaggagacatcatctgaataccaaagtagaatgttggagaaaaaggagcttcaaaagtgggactttattcatatgattcaaatgctgtattatgtaaaagacatcccagctaccctgaaattcttccatagtctcttaggtaccaatgctaagatgctcattattgttgtgtcaggaagcagtggctgggacaagctgtggaaaaagtacggatcacgctttccccaggatgacctctgccagtatatcacatcagatgacctcactcagatgctggacaacctagggcttaagtatgagtgctatgaccttttgtccaccatggatatatctgactgctttattgatggtaatgaaaatggagacctgctttgggattttttgactgaaacctgcaactttaatgccacagcaccacctgatctcagagcagagcttgggaaagatctacaagagcctgaatttagtgctaagaaagaggggaaggttctttttaataatactctgagtttcatagtgattgaggcataactatcaatcacaaaagtatattcaaaaattatattttgaacaactcgaatcactcatttatttccatattaaaatcacaaactcatccattaatgtagataaagcactgtttggatatgagat

SEQ ID NO: 13662 - DNA, 4711 bp, Homo sapiens
agtattggagtgttacagggagacatacaggatttaagaagcccatcatggagaagaccttcaattacagagataaaaagtttttcttgtgaacaagttacactagatggaagataacagactgaggagtgagctgcttctgactcgattaaaaagggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaagacatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttggccgggcatggtagctcaagcctataatcccagcatgttgagaggctgaggtgggcagatcatttgaggccaggagttcaagaccagtctggccaatatggagaaaccttgtctctactaaaaacacaaaaattatctgggcatggtggggcatgcctgtagtcccacttacttgggaggccgaggcacgagaattgcttgaacccgggaggtggaggttgccgtgagccaagatcacgccactgcactccagcctgggcaacagagcaagactctgtctcaaaaaaaaaaatacaatattttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcatatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaacaaggtctatgcattattgtatacagtgtctctagtgcttgtatagtgtctggtatacagagggcactcctatgcatttttaaaacatgctgagcacataccatgtgccaggctttgtgttttatctaatgttatctaatggtattggtgccattatgtaatgttgcctttacaacaacctcatgagggagatttccatctttacaaataggcaaactgaggcccagagagattgaggaactgctccgaggtctgattctggaatgtgcttcctttccactttatcaatctgctcttcgtactcctgtctgaacgatggaaattaatttttgaatgtataaaagacaacagactatgatacagaaatgtcagccccagcccactaagaaagccccagcccatcagtggctaatggctttaataaattggtcatttggctacttggcttgtggacaatctctgacctcttttgaagatgggcactgcatggacttccaggaggtggatttaatagtcttaactcagcatgaaaaagatgctgggatgctcctggctatttatgcaccctaagtgccatagagacatgctgttggcaaggcatggtggctcatgcctgtaatcccagcacactgggaggctgacgcgggcagatggctggagtccaggagttcgagacaagcctgggcaccatggtgaaatcctgtctctactaaaaataaaaaattagccaggggctgtgacgca

SEQ ID NO: 13663 - DNA, 574 bp, Homo sapiens
ttcccggcaggagagcagcatttgtaaaggtatggggtgtacacgagcagggcctatttggggagagtggagaatcagagatgaggctgcacagtaaggtgagaccaggtggaaaaagctctgtgtgatgggtcgaaggtattgacatatactagccactgcccggcaccctccctccgtttccggagtagacctgtttgcttatctcgtgggcatttgccaggctgattagagtaatgagtaaagaaaagagggcactgggaaagctaagttcatttatattagaaattacatgatactcttccataaatcagaaagattgaagagtgggtgaaagaagggaaaagggaattaaaggggaaccaaggcaacctgaagtttttgagagagagagcaggaagatttgaggatgagcaggtgatgctgtagctggcgctatgtagcgacagatgggagaagttctttgtgatggttttgcctctttgagagtcttcagtaaagggagtgagccataactggtggctgctcttgcgccaatgagcctccccaattcctcctgcctcttagaagacaa

SEQ ID NO: 13664 - DNA, 4278 bp, Homo sapiens
accaaactttccccggagccggcgccgggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataataaaaataaaagagagagagaatcagacctgggtggaactctcctgctcctcaggaactatgggagcctcagactcattgtaattcaagctttccgagtcaagtgattgacaactgaagagacacgtggctagggttccactggagaattgaaaaggactcttgagccctcctggaatggagctgtataactgtgcagagactttatccatgccaatagttgctgtccccttccaggggtcaccttgagaggcatgacagctgttccacaggggctatcccttctcagaaaacttctcttctgagcctctttaacagctttctccagaaccagtgtctgaaccaccctggaaattctgccttattatttcttactcaaacatgtttagagtggatagaaaattatgcagcttgcacacccatcgtctttaaccccaaatttcctttggctattaaaaaagtggtggcaaaagacatcctcaaaagaaagagaaatgaaatatttttgaatggttgcacgttaaaaattaaaagaaggaatgggggcagaatgccatatttttgagggctgtactaggtttatctcatttaagccccacaacaccccacaggagggtaattttctaactctagtttgcagaggagcaaattgaggttcagcaaggtgagagaggtacccaaggtcacatagctagttatgtgagaaagttagagtacagatcctctggggtttcagcttattgtagcatattttctccgaaaggcaaaaatgtgcccttttggccgggcatggtagctcaagcctataatcccagcatgttgagaggctgaggtgggcagatcatttgaggccaggagttcaagaccagtctggccaatatggagaaaccttgtctctactaaaaacacaaaaattatctgggcatggtggggcatgcctgtagtcccacttacttgggaggccgaggcacgagaattgcttgaacccgggaggtggaggttgccgtgagccaagatcacgccactgcactccagcctgggcaacagagcaagactctgtctcaaaaaaaaaaatacaatattttaacaatgtgccctcttaagtgtgcacagatacacatacacggtattcccaagagtggtggcagctcaaaatgatatgtttgagtagacgaacagctgacatggagttcccgtgcacctacggaaggggacgctttgaaggaaccaagtgcatttttatctgtgagttctgttgtgtttgtcaaaaagtcattgtaatctttcatagccatacctggtaagcaaaaactagtaaagacataggaacatgtagttttacttggtgtttatgttgcaatctggttgtgatttatattttaaagcttggtgctaaaccacaatatgtatagcatatggagtgcctgtacaagctgatgttttgtattttgtgttcctctttgcatgatctgtcaaagtgagatatttttacctgcctaaaatatgatgtttaaaagcatactctatgtgatttatttatttctacctttctgagtctcttggactaagaagatgttttgaaatgtaccatcaaatgttaacagagtttgatatgggctttctctttggtttctcatcacatttgtaaatgtcttttcaaaaggatttactttttgtaaaaagcttcattctcactctgctttgcatcccccaaacttcttgttcaaaacggggggagtttaggagactttaatcccggtttcagaagctgcagctggtctgtttccaggtcagaaaccattgttcagaagacctccctgtgagagagttgctcctcagggtccctcaggaccaaagaacactcgaaaagagcacttcacacagacaagtggctaagtgtccattatttaccttgaacaatcaaggcaactagtggagagaactgattgtgagctctgcctctgggtcagagagacctggatttgagtctgacaagaacaagaaatggtcaataaatataaattaccagcgtctaaggaacaaggtctatgcattattgtatacagtgtctctagtgcttgtatagtgtctggtatacagagggcactcctatgcatttttaaaacatgctgagcacataccatgtgccaggctttgtgttttatctaatgttatctaatggtattggtgccattatgtaatgttgcctttacaacaacctcatgagggagatttccatctttacaaataggcaaactgaggcccagagagattgaggaactgctccgaggtctgattctggaatgtgcttcctttccactttatcaatctgctcttcgtactcctgtctgaacgatggaaattaatttttgaatgtataaaagacaacagactatgatacagaaatgtcagccccagcccactaagaaagccccagcccatcagtggctaatggctttaataaattggtcatttggcta

SEQ ID NO: 13665 - DNA, 2080 bp, Homo sapiens
atttcaaagcacaccatgccggcagcacttggaggtggtatgtgctgggaaactgaccaacagtttagtcagactgagtcacttcaaggaggggagtggagacagcagtgggtgccagatgacacggagctgtcggcttccgtgtgcattttcttttgatagtagccgtagagaagttgtccgccaggcagccctcaatgggatttttcatttaagaaaaatcactctgctcgtgcactgatggagaaatgaactacaagaagcaagccctgaggtctggagacaggaagctactgaaaccagccagggagtgagccataactggtggctgctcttgcgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaataat

SEQ ID NO: 13666 - DNA, 3095 bp, Homo sapiens
caggagattgcctgctctctgaaaaaccaggaggagctggtagggaaggactggggcgtggaacagggcctcagcttgtttctcgccagttggaatcatatacagccaccactgggagggagccttggagattacctagtgaccaggggctcttatttaatcaagaggcattgcacatgcagttactttattgacgtagtgtttgcactacttcaatagtgcaaagggaggaagggaggaaggagaaaccaccctaatgcccgtgagagggtgatgtggggatgataggataaacctattcatggtgagcctccccacagactgttatgcaaccattagaaggaatgagtgagttctgtccctgctgacctggatgtgggatcacgtgttctgccaagtaagaccagtaagatttagagatgcgttcggagcaggggtggcgtggatgacaggtgacgaactgccgattaaatctggccctctgcctggctttgtacagcccgtggctaagaatggtttttacatttttaaattttggaaaaaaatcaaaaaaaggagatttttatgacacgtgaaaatgatatgaaatttacatttcagtgttcattactgaagttttgttggagtgcagccacgctcttctgtcggcacgtcatctgcatagctgcattcgcactgcaaaggcagagccgagccgtcacaggctgtgaggcagaacgtgtttattacctgacccttttctgaaaaagtttgtcggccaccgccttagagtatgatgacattttgccaaacagcagcaccagatatggttctcagcacttcagaggagtagattcattacatttgtttattcgttcattcattttatcctttattcgtcagatgcttactgtctatctgtggggccaggcaccaggaaccagcagagaacaaacagatgcaggccttcttcttgtggagctgaaagtctgtgtctagatccttcttttctcagtacaagcacttccagcctttccaactctttctcacgagtctcagtgtccagccccttgcatcctgcctcccttctgcctccccagtatgtatcctgattgcccaagtccctcccaaaaagaggtatccaaactggtcccatacttcctggggtcttgccaagaggttgagatctagtagaaggacacatcttgaattgggtcatgctttctatctggtttcaaggtgcttaacatccaacctttgccttttcagctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacaggtaatagccctagccattggtgcacaggatgggggcaatgggaggggatgctactgatgggaatgattaagggagctgctgtttaggtggtgctggtttatgttctaggaactcttcatgagcactttgtaaacaccctcttgcttaatcctcccaacggcccccaaaggtagaacttagctcccttttaaaaggagcacattaaaattctcagaggacttggcaagggccgcacagctggggcct

SEQ ID NO: 13667 - DNA, 2561 bp, Homo sapiens
gtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccagctcctgccctccactgactccagagagggagatccccagtacttgactccatcacgcagatgggagcaggcaccagctatggagagggatacagctgcgtctccacatgacccatcctgcatgacaccaaagccaccgccagacagtgcctcggattctatgcaaaacctgggaagcggagacctaccccagccccgggaggaagctagctcttcaggggaccgtctgaggactggagtttgatccatgaacctggcttcgaggccttgcttttctctcttcttcattcatattcattcccaacaccttagaaggtgttgcttaatttatttctagaaaagcagcccagagtcagtcattgaagccttccccaccccctggccaaaaaaaaaaaaaaaaaaaaactggacacattttggatctgttgggagcttggagtccagtggttggcatagttgtcacattgggagcagagaagaagcaaccaggggccctgatcaggggactgagccgtagagtcccaggatggcacccaatggcacagcctcttccttttgcctggactctaccgcatgcaagatcaccatcaccgtggtccttgcggtcctcatcctcatcaccgttgctggcaatgtggtcgtctgtctggccgtgggcttgaaccgccggctccgcaacctgaccaattgtttcatcgtgtccttggctatcactgacctgctcctcggcctcctggtgctgcccttctctgccatctaccagctgtcctgcaagtggagctttggcaaggtcttctgcaatatctacaccagcctggatgtgatgctctgcacagcctccattcttaacctcttcatgatcagcctcgaccggtactgcgctgtcatggacccactgcggtaccctgtgctggtcaccccagttcgggtcgccatctctctggtcttaatttgggtcatctccattaccctgtcctttctgtctatccacctggggtggaacagcaggaacgagaccagcaagggcaatcataccacctctaagtgcaaagtccaggtcaatgaagtgtacgggctggtggatgggctggtcaccttctacctcccgctactgatcatgtgcatcacctactaccgcatcttcaaggtcgcccgggatcaggccaagaggatcaatcacattagctcctggaaggcagccaccatcagggagcacaaagccacagtgacactggccgccgtcatgggggccttcatcatctgctggtttccctacttcaccgcgtttgtgtaccgtgggctgagaggggatgatgccatcaatgaggtgttagaagccatcgttctgtggctgggctatgccaactcagccctgaaccccatcctgtatgctgcgctgaacagagacttccgcaccgggtaccaacagctcttctgctgcaggctggccaaccgcaactcccacaaaacttctctgaggtccaacgcctctcagctgtccaggacccaaagccgagaacccaggcaacaggaagagaaacccctgaagctccaggtgtggagtgggacagaagtcacggccccccagggagccacagacagaccatggctttgccttccagaatgctggtctgtggaactgacccattcattcattcatttgttcattcattcatttgcaaacattcatccaattcccaccacatgccaggaattatgatgaatactggggatgtagaaatgagattttttgggtttatggtgatgaagttacagaaaatcaatggcacagccctggtctcagctctgccgtcactcaacttgtatcttgagcaagttcctccccatctcaggcctcagtttcctcatcgcatagagagttggtcttccctcaccgggcttcctacttgccctccagagttgcctgaagctcacatgagcgaagggacatgaacatgctctgccatctcccaataggacataagtccacgctggagcgctgagcatcagactcaagaaaagcttgcgtggatattgcagacccaccaacaagggctccaggttctggagttgtggaggcaaaactgcctagtgagaaccctacatattccctctggtccttgcagctgccacccccattcccaggggtggagtgtccctccatagacttggatcctgggccctctgctccttcaccactgtccatctgaagcaagcctggttgctccggcactgaactgtggcctcgggccctggaccctgcccctcaaatccaccctccaagtgcacacctggaaacttccgcttccagtcctgatgggtaaaacgcccacctaccatatccttgcgcaatctcttattcaggaggcagctggagtgcaaagctgacttagttcacaaagtataaaaaaatacagggatgtggttcagctagaa

SEQ ID NO: 13668 - DNA, 3668 bp, Homo sapiens
ggaagactacacattttaggtatgtgattagaaaacatacttgtcagaattgtctggctggattaatttgctaatttgaccttcttcatcatttgatgtgatgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtgggtgtgatctccattcctttgtacatccctcacacgctgttcgaatgggattttggaaaggaaatctgtgtattttggctcactactgactatctgttatgtacagcatctgtatataacattgtcctcatcagctatgatcgatacctgtcagtctcaaatgctgtgtcttatagaactcaacatactggggtcttgaagattgttactctgatggtggccgtttgggtgctggccttcttagtgaatgggccaatgattctagtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgcttagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaaagacaattttctcacctctgtaaattttagtctcaatctcacctaaatgaatcaggtctgccctttatcttgcccttttcattctaccaacagatctgcactttgaagtcaatggtaaattactccagtgaataatagcagtataatatgacttgataatatttttgtaaacttgtagtcataatagtactatattcttcttagtcctcacctcttccttgtcttttagatcttaatttcatgctgattacaaaaatccagttttgttttctttctatgttccatgcataatacagtcttaagtgaatttctcttttttaattttatcgtaatagaaacttatccagtttgaaaatcattccctaaagcatgcaataggaaaaagaacctcctggctgggactgcccaactctgttctgatcagtgggtgggtgaggtagggtttgagttggcaagagcagggaacgggcatgtgcccaggtgagctcctgtgtgtgtccagattttatattcctaatcccagtaaggaagaaagcgtagtgtgggagaggagagagctgatgactgcagttctcaaaggtcctcagtgaagttattttggaggccctggtggtcacaggatcagaaggcaagggataggcagtggtcaccaatggttgaaagtatggcttgtcccatttcttcctgttctctttttctagcttccacatcagcttccttttttgagaacatatagaagaagaaggctaagagatggtgaagagactgcatgattaaactagatagacctggtatacagtcactgaactagtagatgtcaataattattatttttaaaaatttttatttgttggccgggcatggtggctcacgcctgaaatcccagcactttgggaggccaaggtgggcggatcatgaggtcaggagatcgagaccatcctggccaacatggtgaaaccccatctgtactaaaatacaaacaagtagctggttgtggcgccgcatgcctgtagtcccagctactcgggaggctgaggcaggggaattgcttgaacccgggaggcggagtttgccagcctggcaacagaacaagactctgtctaaaaagaaaaaaaaatttttttgtttaagacagcatcttgctctgtctcccaggctggagcgtagtaatgcaatcatagctcactgcagcctggaactccttggctcaagcaatcctgctgccttggcctcccaagtatgtaggactacaggtactcgccaccacacctggataattaaaaaattatttctgtagagatgaagtctcactgtgttgcccagcctgggtgtcaataattattttttaaaaaaaatttttaaaaaggttttttgagacagattcttgctctgtcacccaggctggagtgcagtagcatgatcagggatcactgcaacctctgcctcctgggttcaagcgattcttgtgcctaagccacctgagcagctgggattacaggtgcatgccaccatgcctggctaattttggtatttttagtagagatgaggttttgccattttggtcaggctggaatttttttttttttaattttgataagacagggtattgccgtgttggccagactggtctcaaactcctgggctgaaacaatcctcccgccttggcctcccaaagtgctgggattataggcacaagacaccacaataattattgcctgtatgtcaattattattttaaaatattgttgtatttacttaatgtctttaatgcatttgcccaatattttacattgtactgctcagaggtattcctttattatgtggttagcataggttatactttgctgacgattcacattttattagtttggttatgttttgtccttttaaaacattttcttttgagatgggggtcttgctctgttgcccacgcaggagtgcagtggcatgctctcagctcactgcagccctgactgcctaggctccagcaatcttcttacgtcagcctccagagtagctgggaccgcaggcacttgccaccacgccccactaaaaattttttaaattgttgcctttcttgaagtgttctctgcctgtctttgtcacaaaatttcatttttctcatagttaatttcatctctccggtaagattttattggtgtttcttttataactttgcagttcttacaccgtttggtgattttcatgtttcttagaaactttaaacctttaacttcaaacattaaaatacaagtcttttaagtacatgagtgcttagaaatgtacataatgtttatatacacttatgccttacattaaagtccaatatgagaaatacatgtttaacattcaataataattttaaaaatttgagaaataaactctcataaatgca

SEQ ID NO: 13669 - DNA, 3403 bp, Homo sapiens
ggaagactacacattttaggtatgtgattagaaaacatacttgtcagaattgtctggctggattaatttgctaatttgaccttcttcatcatttgatgtgatgccagatactaatagcacaatcaatttatcactaagcactcgtgttactttagcattttttatgtccttagtagcttttgctataatgctaggaaatgctttggtcattttagcttttgtggtggacaaaaaccttagacatcgaagtagttatttttttcttaacttggccatctctgacttctttgtggtttcagagtcttggaaggatgaaggtagtgaatgtgaacctggatttttttcggaatggtacatccttgccatcacatcattcttggaattcgtgatcccagtcatcttagtcgcttatttcaacatgaatatttattggagcctgtggaagcgtgatcatctcagtaggtgccaaagccatcctggactgactgctgtctcttccaacatctgtggacactcattcagaggtagactatcttcaaggagatctctttctgcatcgacagaagttcctgcatcctttcattcagagagacagaggagaaagagtagtctcatgttttcctcaagaaccaagatgaatagcaatacaattgcttccaaaatgggttccttctcccaatcagattctgtagctcttcaccaaagggaacatgttgaactgcttagagccaggagattagccaagtcactggccattctcttaggggtttttgctgtttgctgggctccatattctctgttcacaattgtcctttcattttattcctcagcaacaggtcctaaatcagtttggtatagaattgcattttggcttcagtggttcaattcctttgtcaatcctcttttgtatccattgtgtcacaagcgctttcaaaaggctttcttgaaaatattttgtataaaaaagcaacctctaccatcacaacacagtcggtcagtatcttcttaaagacaattttctcacctctgtaaattttagtctcaatctcacctaaatgaatcaggtctgccctttatcttgcccttttcattctaccaacagatctgcactttgaagtcaatggtaaattactccagtgaataatagcagtataatatgacttgataatatttttgtaaacttgtagtcataatagtactatattcttcttagtcctcacctcttccttgtcttttagatcttaatttcatgctgattacaaaaatccagttttgttttctttctatgttccatgcataatacagtcttaagtgaatttctcttttttaattttatcgtaatagaaacttatccagtttgaaaatcattccctaaagcatgcaataggaaaaagaacctcctggctgggactgcccaactctgttctgatcagtgggtgggtgaggtagggtttgagttggcaagagcagggaacgggcatgtgcccaggtgagctcctgtgtgtgtccagattttatattcctaatcccagtaaggaagaaagcgtagtgtgggagaggagagagctgatgactgcagttctcaaaggtcctcagtgaagttattttggaggccctggtggtcacaggatcagaaggcaagggataggcagtggtcaccaatggttgaaagtatggcttgtcccatttcttcctgttctctttttctagcttccacatcagcttccttttttgagaacatatagaagaagaaggctaagagatggtgaagagactgcatgattaaactagatagacctggtatacagtcactgaactagtagatgtcaataattattatttttaaaaatttttatttgttggccgggcatggtggctcacgcctgaaatcccagcactttgggaggccaaggtgggcggatcatgaggtcaggagatcgagaccatcctggccaacatggtgaaaccccatctgtactaaaatacaaacaagtagctggttgtggcgccgcatgcctgtagtcccagctactcgggaggctgaggcaggggaattgcttgaacccgggaggcggagtttgccagcctggcaacagaacaagactctgtctaaaaagaaaaaaaaatttttttgtttaagacagcatcttgctctgtctcccaggctggagcgtagtaatgcaatcatagctcactgcagcctggaactccttggctcaagcaatcctgctgccttggcctcccaagtatgtaggactacaggtactcgccaccacacctggataattaaaaaattatttctgtagagatgaagtctcactgtgttgcccagcctgggtgtcaataattattttttaaaaaaaatttttaaaaaggttttttgagacagattcttgctctgtcacccaggctggagtgcagtagcatgatcagggatcactgcaacctctgcctcctgggttcaagcgattcttgtgcctaagccacctgagcagctgggattacaggtgcatgccaccatgcctggctaattttggtatttttagtagagatgaggttttgccattttggtcaggctggaatttttttttttttaattttgataagacagggtattgccgtgttggccagactggtctcaaactcctgggctgaaacaatcctcccgccttggcctcccaaagtgctgggattataggcacaagacaccacaataattattgcctgtatgtcaattattattttaaaatattgttgtatttacttaatgtctttaatgcatttgcccaatattttacattgtactgctcagaggtattcctttattatgtggttagcataggttatactttgctgacgattcacattttattagtttggttatgttttgtccttttaaaacattttcttttgagatgggggtcttgctctgttgcccacgcaggagtgcagtggcatgctctcagctcactgcagccctgactgcctaggctccagcaatcttcttacgtcagcctccagagtagctgggaccgcaggcacttgccaccacgccccactaaaaattttttaaattgttgcctttcttgaagtgttctctgcctgtctttgtcacaaaatttcatttttctcatagttaatttcatctctccggtaagattttattggtgtttcttttataactttgcagttcttacaccgtttggtgattttcatgtttcttagaaactttaaacctttaacttcaaacattaaaatacaagtcttttaagtacatgagtgcttagaaatgtacataatgtttatatacacttatgccttacattaaagtccaatatgagaaatacatgtttaacattcaataataattttaaaaatttgagaaataaactctcataaatgc

SEQ ID NO: 13670 - DNA, 580 bp, Homo sapiens
aacgtgtttaaatacatcagccatatagaaaaggacatctcttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtttgactggcaaattcactttttactcatttattctcattcatcataccgcatcacactaccactgctttttgaagaattatcataaggcaatggagaataaaagaaagaccatgatttagtgaattctgtgtttcatgatacttcccttcctaattatcatttgattagatacttgcaatttaaactgttaagctgttttcactgctgtttctgagtaatagaaattcattcctctccaaaagcaataaatttctagcacatta

SEQ ID NO: 13671 - DNA, 623 bp, Homo sapiens
atctcttgagacttcacttcagcttcactgacttcttgactctcctcttgagtaaaaggactcagccaactatgaagttttttgtctttgctttagtcttggctctcatgatttccatgattagcgctgattcacatgaaaagagacatcatgggtatagaagaaaattccatgaaaagcatcattcacatcgagaatttccattttatggggactatggatcaaattatctatatgacaattgatatccttagtaatcatggggcatgattatagaggtaagctgactctagttgcttgtctttctagaagtgtcaacactgacagtttaaaaaaaaagccataagctaacaaccattccagtttaagaaatgtagcatgggttagctccttgaagtgtattcatttgtataaatgcttctgaagctgtagatatgtggtgttatttctgaggtctctgttctgtgccattggtctgtatgttgttttggtactggtaccatgctgttttggtaactgtagctttgtagtatagtttgaagtcaggtagtgtgatgccttcagctttgttcttttgcttacaattgtcttgggtatatgagcttttctttggatccatatga

SEQ ID NO: 13672 - DNA, 578 bp, Homo sapiens
gggagatttcaacgtgtttaaatacatcagccatctaggaaaggacatctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcacggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcacattattatgtg

SEQ ID NO: 13673 - DNA, 775 bp, Homo sapiens
ggacatctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcacggggcatgattatggaggtctctgcttgctatctgatctacgacaatcctgacaaaaacaagcaatgggaaaaggatctcctagtcaataaatggtactgggaaaactggctagccatatacagaaaactgaaactggaccccttccttacaccttatacaaaaattaactcaagatggattgaaaattaaatgaaaaacccaaaaccaaaaaaagaccctagaagaaaacctaggtgatatcattcgggacataggcatggacaaagacttcatgaagaaaatgccaaaagcaatggcaacaaaagccaaaattcacaaatgggatctaattaaactaaagagcttctgcacaacaaaagaaactatcatcagagtgaacaggtaacttagagattgggagaaaatttttgcagtctacccatctgacaaaggtgtagtgtccagagtctacaaggaacttaaacaaatttacaagacaaaaacaaaaaacccgtctaaaagtggacaaaggatatgaacagacact

SEQ ID NO: 13674 - DNA, 2705 bp, Homo sapiens
gggagcttgtctgaggctggagctctattgtctgaatccaggggcagaaagaactgagggctcttttacggcatccacctggaggctgcctgcaggcttgggttgctaagtgcactgcttaatttagaagcgccttttatcctggctctcttgaccagtcaaagttgtggtcgctgttttctacaaggactggggaaagaaagggtggaattaattaaacctggaggaagggactttgaagggcggagctaaggtcaaagaaagaaccctttaaataaagggcccacactggctgccagggagtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaa

SEQ ID NO: 13675 - DNA, 2382 bp, Homo sapiens
ctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccg

SEQ ID NO: 13676 - DNA, 1265 bp, Homo sapiens
gaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccg

SEQ ID NO: 13677 - DNA, 1362 bp, Homo sapiens
atgggccaccataggccatggctgcacgcttctgtcctctgggctggggtggccagcctgctcctccccccggccatgacccagcagctcagaggggatgggctaggcttcagaaaccggaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggag

SEQ ID NO: 13678 - DNA, 1081 bp, Homo sapiens
gcattccccaggagacaagaaaggaggatagaaaaacgacttaggaatctccttggagctcaagaccaggaacttccccaagccggaggtccctgaggcgctctagcgcgctggccgcactcgcagcccaggtcgccagtgcgcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcttatagtctctctgagtgttgcgtttgatttgttattttaaaaacatatttgttggaatatgtgaaggtgggtttataattttggatgtttcttgctttttcttcccaaggaggactcaacatatgaacatcgcattgttttaatggtgttactagtctttgaagacaaataatgagagtttataaatttagctttaacttcgaaatatctttccaggctaaaataggtccaacttagatttttaagctaattctcacattttcta

SEQ ID NO: 13679 - DNA, 628 bp, Homo sapiens
cgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 13680 - DNA, 3311 bp, Homo sapiens
gccggttttgaggccggcctccggctttgaagttcctcaccgcgtctccttccctctccccaaagcctggatcaccgcccagcgtcaggcgaggggcgacgtctcgaggtaaaacggaggaggtgcgggacgcggagactgcgcgggcccggtagccctggagaggccgaggctctaggccgcgaggggcgggtgcaatggcggaggaacaggtgaaccgcagcgccggcctggcccccgactgtgaggcctcggcgactgcagaaactacggtttcctcagtggggacctgtgaagccgctggcaagtcaccagagcccaaggactacgacagcacctgcgtgttctgccggatcgcggggcggcaggacccgggcaccgaactcctgcactgcgagaatgaggacctaatttgcttcaaagatatcaaaccagcagcaactcatcattatcttgtggtgccaaagaagcatattggaaactgcagaactctaaggaaagatcaagtagaactggttgagaacatggtaactgttggaaaaaccattcttgaaagaaataatttcactgacttcacgaatgtgaggatgggttttcatatgccaccattctgttccatttcccacttgcaccttcatgttctggcaccagtggatcagcttggcttcttatccaagttggtttatagagtcaattcctattggtttatcacagctgatcacttgattgaaaaactaagaacatgaaaatgtcaagagtggaagatttttctaatcttggttcagcatgaagtggtatttaggtcccttttaagtctaattgcaattttaagatttgttgggttttatgagaggctgttacttagtggccttaaatcttttctgaatgtctgtttcctaagatctgtgatacagttatgtgaatattttgttactgacttgtttcaatggttacttgtataaggattttatatatatgatactatagataaaatcctatttaagacaaattctgttaatcaacaagggctctgtatttttttaagttaaaatattttcatttctcagtaagtagtcagttataatagtgatttatttatgaagaataaactactatagaaagtactttgtgggaacctttattactgtgaaggagaaaaatagctatttcttgacagttctatagttatacacataaattttcaaaataaagaataccatactacacaatgatctctgattttgctgagggaaggaattatatatgtgccactttttcctcaaatttcagatgccagttttcactttttgaagcattgcatctttttaataaatctatcctgaaagctatataatatatataatttatatcaatgaatttacaataactatcaaattggctatcagaattcactgtaatggaattttgcctctaataacataaagggggaagaaacataaagtggttctcttaataaaactagcagaaaatgttgctttatggcatgtttttgtatcaaagagaaatcagaggttaaactttgcttttatcatgaaaagggcctgatttgaaggtagagataggcttagatgagaaaaattgataacgcaatgttaatactattgatatttcataggtatattttgttagaaattggttttttggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttttttagagggggcatgatattaaagatagttttaagtaacaaattacttattacaaagttacaacatgtggaatcaatagttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaggctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaaaaatgtggttagccaattgattcaacttttataggtttatatgctctcatgtaaacctatttgtttccgagatcagacgagatcgggcgcgttcagggtggtatggccgtagacaacctatttgttaaaaacccttggaaacacatcttttagtagaggttcttatttacttataaagattaataatcaaattactacaattaatatccatttagccttttcagtagtctaaatatttggtaactccctagccatctataacactagttcaaaacaaggctaattcataacctgtcttaaaaatgtttgaagtggtatcaagagcattgtttatgcatgttgtgatactatttgtggaactgtttaatgagctatttcaaactgctagaagaaaatgaaataaaaatggaaaaatactgtc

SEQ ID NO: 13681 - DNA, 2015 bp, Homo sapiens
ttaatcaattgcgtgtgtttcagaaagtctgtataaaattctctgcagtggcagatcatagcaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgccccagacaccatttccccagacaccccaatgtctttggattctgcagagcagatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccatggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccccgtcccttccattgcagacaaattggatctgtgtaccgactccctcctctaagaaaaggtgaggtgctgccacttcctgaggccaattttcccagcttcccattgccgcaccacaaacatcctctaaagccagacaatcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactattgtta

SEQ ID NO: 13682 - DNA, 1401 bp, Homo sapiens
aggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagac

SEQ ID NO: 13683 - DNA, 1774 bp, Homo sapiens
gaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggag

SEQ ID NO: 13684 - DNA, 1789 bp, Homo sapiens
aggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcct

SEQ ID NO: 13685 - DNA, 1810 bp, Homo sapiens
cagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgg

SEQ ID NO: 13686 - DNA, 3334 bp, Homo sapiens
cccttactacatatccgtgtataagtcattcatttaatcttgcagcctccgtttcctcaactgcagaatggaaatcaaaactccaacctctcaagattgctccaaggattaaatgaccaggcatccaaatcgcttagttcagtgtcagtacatagtgggcactcgataaaaaccgattgtaacactactggaatacaggccgcgaggctatgcgttcagatctggagaccctgctgggacagaccagagataattctgtctcgctcacctggctttggcaacggaccgccccggtgcacgaagcgcagggcggtcgcaggagctggctgagcagcgaagcccaggccctcctgggaagaagtccgagcaggggcatcgcgcggcaggacgccggctttccgggacaggaacaaaaggcctgggaaggaggcgggtcagacaccaggaagggtggagggcactgcaaaggcggaacccgcgcaccagggaaaactcgggcgtttgcgcacctcactagtcacgaaggctgaggtgggatcctcccaagttcccttagtagccagcttcggcacttccgggaggagccggaaataatttttgtgctcggcggaggctctctaggcgtgcgacccagcgactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctcgggaggcagcccccgtacatacgcacccgcgactttgcagctttcacctgaaggtctgagcgaagcccgggcggcgcacgtgcagtggatacctccacccccctgggaggcggggtcgcgctcagagccaatgagagcttgcggggtggaggggtagggaagcttccagaggccggtggggaggaagttataaagagggtacgagggggccagctggagagccatgcagtccaagcgggattgtgaggtaagcggctggcgacttgggggccggcgagccccgccggagcgggggtcggctttagggaccccagtaccacaggagaggtgggggcgcgcttggcgatccgccattccaaccttcctttccctctcagctgtggtgtgagagggtgaatccagagaacaaggcggcgctggaggcgtgggtcagggagacaggcatccgcctggtgcaggtgaacgggcagaggaagtatggcgggccacccccaggtacggtagtcccagcccctccgcctgtccggctacaccagccccctttgggggaggggctgctccgagccttcactgtcagaaactgcgaactaccc

SEQ ID NO: 13687 - DNA, 3494 bp, Homo sapiens
ttgaaactctgtacccattaaacaataactccccacttcaccctccctccagcccctggtaactgctatcctactttctactttctgtctctatggatttgactattctaggtactagataagtgagagactaattgttctttttttttttttttaagttcattgatctagctttcaaattccacattgcaaccaatctttaagaaacaaccacttgttggattctgatgtagtaccaaagaaaaatatccacagttagctgaaaagtttgttaaaatactcttccttttacaactacatatctgtgtaaggttagattttcgttatatacttcaaccagcacgacatatcacgacagattgaatgcaaaaatcacatatgagaatcctgctgtcttctattcagtcagacattaaagatttgcaaagatgtaaatcagtgccactcttctcactaaattgttttggaaaacagttacctttttctaaaatattatttgcgttaacatataatagatatattatttgtgttaacatatgttatttgttaaatgaataaatattttaaaatttttgccgttctaattctaatacagtaaatattgataggtataatccactttggggtcttgaatacatagtaagagtgtaaagaggtcctgaaaccaaagactttggagtagggtataaaagcccagattggaagctctgacctggaaggacaacacagttctagtcctgactgccacgaacatgctgaatggccttaagaaatgacttaacttctcaacatcctgtacttcatctgtaaaatttatctgcctagcctatgtcatagagttgttaccagaaacaaattagagaacaaacagttgtaactaagatttaaaagaaaagttatattgggagagaaacgttgcttataaaatttggaattcaattagttgagccagtttgagttggttatattgcctataatcatgtaggtatttttttgttgttattatttttgtttgtttggttgggtttgtttttgtttttgtttttgttttgacagagtcttgctctgtctcccaggctggagtgcagtggcactatctcagctcactgcaagctccacctgccgggttcacgccattctcctgcctcagcctcccaagtagctgggactacaggcacctgccaccacgcccggctaatttttttgtatttttagtagagacggggtttcacagtgttcgccaggatggtcttgatctcctgacttcgtgatccgcccgcctcggcctccccaagtgctggcattacaggtgtgagccaccgcgcccggctggttggtttgttttgtttttgagacagagtctcgctctgtctctcagtctggagtgcagtggtgcaatcttggctcactgcaacctccgcctcccaggttcaagtgattctccctgccttgagcctcctgagtagctgggattacaggcacctgccaccaccatttgtttgttttattgagacagtctcactctgttgcccaggctggagtgcagtggcacaatctcggctcactgcaacctccacctcccaggttcaaggatcctcatgcatcagcctcccaagtagctgggactacaaggggcgtgtcgtcgcacccggctaatttctgtatttttagtagagacgaggtttcaccatgttggccaggctggtctcgaacccctgacctcaggcaatccatctgccttggcctcccgaagtgctgggattacaggcgtgagccactgtgcctggcctcagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggtatatcggcgggataacccagccatgacccgtggccgataccgggaattctaccagtgtgattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgg

SEQ ID NO: 13688 - DNA, 950 bp, Homo sapiens
gactcgatagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagagg

SEQ ID NO: 13689 - DNA, 1780 bp, Homo sapiens
atagccggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacgg

SEQ ID NO: 13690 - DNA, 1896 bp, Homo sapiens
ggaagtcatccttgctgaggctggggcaaccaccgcaggtcgagacagcaggcggctcaagtggacagccgggatggcagagcgtgcggcgctggaggagctggtgaaacttcagggagagcgcgtgcgaggcctcaagcagcagaaggccagcgccgagctgatcgaggaggaggtggcgaaactcctgaaactgaaggcacagctgggtcctgatgaaagcaaacagaaatttgtgctcaaaacccccaagggcacaagagactatagtccccggcagatggcagttcgcgagaaggtgtttgacgtaatcatccgttgcttcaagcgccacggtgcagaagtcattgatacacctgtatttgaactaaaggaaacactgatgggaaagtatggggaagactccaagcttatctatgacctgaaggaccagggcggggagctcctgtcccttcgctatgacctcactgttccttttgctcggtatttggcaatgaataaactgaccaacattaaacgctaccacatagcaaaggattttgacattgctgggaactttgatcccatgatccctgatgcagagtgcctgaagatcatgtgcgagatcctgagttcacttcagataggcgacttcctggtcaaggtaaacgatcgacgcattctagatgggatgtttgctatctgtggtgtttctgacagcaagttccgtaccatctgctcctcagtagacaagctggacaaggtgtcctgggaagaggtgaagaatgagatggtgggagagaagggccttgcacctgaggtggctgaccgcattggggactatgtccagcaacatggtggggtatccctggtggaacagctgctccaggatcctaaactatcccaaaacaagcaggccttggagggcctgggagacctgaagttgctctttgagtacctgaccctatttggcattgatgacaaaatctcctttgacctgagccttgctcgagggctggattactacactggggtgatctatgaggcagtgctgctacagaccccagcccaggcaggggaagagcccctgggtgtgggcagtgtggctgctggaggacgctatgatgggctagtgggcatgttcgaccccaaagggcgcaaggtgccatgtgtggggctcagcattggggtggagcggattttctccatcgtggaacagagactagaggctttggaggagaagatacggaccacggagacacaggtgcttgtggcatctgcacagaagaagctgctagaggaaagactaaagcttgtctcagaactgtgggatgctgggatcaaggctgagctgctgtacaagaagaacccaaagctactgaaccagttacagtactgtgaggaggcaggcatcccactggtggctatcatcggcgagcaggaactcaaggatggggtcatcaagctccgttcagtgacgagcagggaagaggtggatgtccgaagagaagaccttgtggaggaaatcaaaaggagaacaggccagcccctctgcatctgctgaactgaacaaactatcagaggaaaggaagtgggactggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggag

SEQ ID NO: 13691 - DNA, 2483 bp, Homo sapiens
aaaaattatttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaata

SEQ ID NO: 13692 - DNA, 1442 bp, Homo sapiens
attcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttacttgaggttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcaga

SEQ ID NO: 13693 - DNA, 2118 bp, Homo sapiens
ctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaaggattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgt

SEQ ID NO: 13694 - DNA, 2340 bp, Homo sapiens
ctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgt

SEQ ID NO: 13695 - DNA, 1426 bp, Homo sapiens
gttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggattttgacattgctggtcagtttgaccctatgatccccgatgcagagtgtttgaagatcatgtgtgaaatcctaagtggattgcagttgggagactttctcattaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctac

SEQ ID NO: 13696 - DNA, 1562 bp, Homo sapiens
cttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtga

SEQ ID NO: 13697 - DNA, 1809 bp, Homo sapiens
ggagggagcacgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaa

SEQ ID NO: 13698 - DNA, 1606 bp, Homo sapiens
ggagggagcacgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaa

SEQ ID NO: 13699 - DNA, 1424 bp, Homo sapiens
gggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaaggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggcc

SEQ ID NO: 13700 - DNA, 1753 bp, Homo sapiens
ggagggagcacgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaa

SEQ ID NO: 13701 - DNA, 4264 bp, Homo sapiens
gagccgcaggctgaggccgggaagggtcgggggcgaggccgcgtcgccgcctccccgaagccttttcctgttggggggagggcccgccagtgacggccgggcctgtcacgtgggcctgacagctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 13702 - DNA, 4015 bp, Homo sapiens
agctacagcccctaccgggcgggacggcaggggccacagcagagaggccgggaccccggcattcagctcacggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 13703 - DNA, 3339 bp, Homo sapiens
gacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcggggacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacaggggtgagtgtccggcggggcccaggggcggacgctggctccctgcgacccaccctggcccttcaccagagacgcctctttctccagccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagctta

SEQ ID NO: 13704 - DNA, 3814 bp, Homo sapiens
aggagcccggtgtcccggagcacaggccagggccgggccagaagcccatccgacatccagctgaccctcaccctctgaccccagccctcagcgccatgagtcgggggcaaagagttctcaagggtctgctgggctgggtttgcacttggacctgggcctggagagccagacttggagcaaggggctgtggccttcatgtcctgtgccccagagatctgcccctcccacccgaggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaag

SEQ ID NO: 13705 - DNA, 3750 bp, Homo sapiens
cggagacccccatcggtcagctgccaggccccacgcgctcgcggtctccgcgccccgacggctgcgccatgtgtatctgcgggacggcgcacccggtgctggacgagggccccgtgcgctgccgggcgggcccccgagacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 13706 - DNA, 3351 bp, Homo sapiens
agctggggagggggtggccggcgacaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgca

SEQ ID NO: 13707 - DNA, 4191 bp, Homo sapiens
tcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcggggccccacttcatttctggggaaactgaggccgtgtccaggccggaaaatccctttaacgagctcccctcggacctgcccaaggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcg

SEQ ID NO: 13708 - DNA, 679 bp, Homo sapiens
attcactgggaactaacacccggcgccgctcagacatctctattcccgcctctccgacccggtctcacttcgctcctgggcagctgcgcggagaactggggctcaccgtcatggatgctctatcagaagcaaatggcacatttgcattaaaccttttgaaaaagctaggggaaaacaactcaaacaacttatttttttccccatgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaaggtgaaaatatattgttattctatttcgataatattttaaacagttttatagtcagttctttacaaaactgtcaaatataaaaaggagtccttttttctctaaacaactatgcaaacattaaaacctttctttggaaa

SEQ ID NO: 13709 - DNA, 162 bp, Homo sapiens
atggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataa

SEQ ID NO: 13710 - DNA, 781 bp, Homo sapiens
taggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaaattcagttagaagtttcttctagtaacccaacggctcttttaagagccaccta

SEQ ID NO: 13711 - DNA, 790 bp, Homo sapiens
aacctgctctttagatttcgagcttattctcttctagcagtttcttgccaccatgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaaaagaagtaggaagctggcgtgtgaaaaccgcaacaaagccccaaaggctcttttcagagccaccca

SEQ ID NO: 13712 - DNA, 732 bp, Homo sapiens
catcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccacca

SEQ ID NO: 13713 - DNA, 777 bp, Homo sapiens
catgctgttctgacagtttgagattacttattgtcttttctgggaagacaaaaacatgtcggagactgctccacttgctcctaccattcctgcacccgcagaaaaaacacctgtgaagaaaaaggcgaagaaggcaggcgcaactgctgggaaacgcaaagcatccggacccccagtatctgagcttatcaccaaggcagtggcagcttctaaggagcgcagcggcgtttctctggccgcgcttaagaaagcgcttgcggctgctggctacgatgtagaaaaaaacaacagccgtatcaagcttggcctcaagagcttggtgagcaaaggtactctggtgcagaccaaaggtaccggtgcttctggctccttcaaactcaacaagaaagcggcttccggggaaggcaaacccaaggccaaaaaggctggcgcagccaagcctaggaagcctgctggggcagccaagaagcccaagaaggtggctggcgccgctaccccgaagaaaagcatcaaaaagactcctaagaaggtaaagaagccagcaaccgctgctgggaccaagaaagtggccaagagtgcgaaaaaggtgaaaacacctcagccaaaaaaagctgccaagagtccagctaaggccaaagcccctaagcccaaggcggccaagcctaagtcggggaagccgaaggttacaaaggcaaagaaggcagctccgaagaaaaagtgaaactggcgggacgttcccctttgaaaattttaaacggctcttttcagagccaccca

SEQ ID NO: 13714 - DNA, 785 bp, Homo sapiens
agtcccggccagtgcctctgcttccggctcgaattgctctcgctcacgcttgccttcaacatgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaagaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtagaaagttcctttggccaactgcttagaagcccaacacaacccaaaggctcttttcagagccaccca

SEQ ID NO: 13715 - DNA, 725 bp, Homo sapiens
catgcttttcgctggttattacatcttgcgtttctctgttgttatgtctgaaaccgtgcctgcagcttctgccagtgctggtgtagccgctatggagaaacttccaaccaagaagcgagggaggaagccggctggcttgataagtgcaagtcgcaaagtgccgaacctctctgtgtccaagttgatcaccgaggccctttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaagtcagtttctgccaagaccaagaagctggttttatccagggactccaagtcaccaaagactgctaaaaccaataagagagccaagaagccgagagcgacaactcctaaaactgttaggagcgggagaaaggctaaaggagccaagggtaagcaacagcagaagagcccagtgaaggcaagggcttcgaagtcaaaattgacccaacatcatgaagttaatgttagaaaggccacatctaagaagtaaagagctttccgggaggccaatttggaaagaacccaaaggctcttttaagagccaccca

SEQ ID NO: 13716 - DNA, 477 bp, Homo sapiens
atgtctggtcgcggcaaacaaggcggtaaagctcgcgccaaggctaagactcggtcttctcgtgcaggtttgcagtttcctgtgggccgagtgcaccgcctgctccgcaaaggcaactactccgagcgcgtcggggctggcgcgccggtgtatctcgcggcggtgcttgagtacctgaccgccgagatcctggagctggcgggcaatgcggcccgcgacaacaagaagacccgcatcatcccgcgccacctgcaattggccatccgcaatgacgaggagcttaataaactcttggggcgtgtgaccatcgcgcagggtggcgttttgcctaatattcaggcggtgctgctgcctaagaaaactgagagccatcataaggccaagggaaagtgaagagttaacgcttcatgcactgctgtttttctgtcagcagacaaaatcagcctaacagcaaaggctcttttcagagccacctac

SEQ ID NO: 13717 - DNA, 1615 bp, Homo sapiens
gtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaggg

SEQ ID NO: 13718 - DNA, 546 bp, Homo sapiens
aaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagccccccta

SEQ ID NO: 13719 - DNA, 393 bp, Homo sapiens
atgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaa

SEQ ID NO: 13720 - DNA, 547 bp, Homo sapiens
cagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctc

SEQ ID NO: 13721 - DNA, 531 bp, Homo sapiens
cttttcgcgcccagtagaggctataaaatgtacgtttttctagtttcacttcagtctttcttgaccgtatagataataggccttttgccatgtctgggcgtggcaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctactgcccaagaagaccgagagccaccacaaggcgaagggcaagtagaagcctggattagtttgcagcaactcaatcccaaaggaaccaaaggctc

SEQ ID NO: 13722 - DNA, 496 bp, Homo sapiens
cttttcgcgcccagtagaggctataaaatgtacgtttttccaatttcatttcagtctttcttgaccgtaaaggtaatagaccttttgccatgtctgggcgtggtaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctgctgccaaagaaaactgagagccaccacaagactaagtaaagaccgagttgaaaagcgca

SEQ ID NO: 13723 - DNA, 460 bp, Homo sapiens
atgtcgggacgtggcaagcagggcggcaaagctcgcgccaaggctaagacccgttcttcaagggcgggtcttcagttcccagtgggccgagtgcaccgactgctccgcaagggcaactacgctgagcgggtcggtgccggagcgccggtgtacctggcggcggtgttggagtacctaaccgccgagatcctggaactggctggcaacgcggcccgcgacaacaagaagacccgcatcatcccgcgccacttgcagctggccatccgcaacgacgaggagctcaacaagctgcttggtaaagtgaccatcgcccagggtggtgtcctgcccaatatccaggccgtgctgctgcctaagaaaactgagagccaccacaaggccaagggcaagtagcggggctggagcagttcattactcatacctcggtccaaaccaaaaaggttcttttcagagccaccta

SEQ ID NO: 13724 - DNA, 573 bp, Homo sapiens
cacagctttattttcgcgcccagtattgactataagtagtggagctctggtgaacttctctcggctgttctcagttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcggcggtgctggagtacctgactgccgagatcctggagctggcgggcaacgccgcccgcgacaacaagaagacccgcattatcccgcgccacttgcagctggccatccgcaacgacgaggagctcaacaagctgctgggcaaagtaaccatcgctcagggtggtgtcctgcccaacatccaggctgtgctactgcccaagaagaccgagagtcaccacaaggccaaaggcaaataatgtctccatagaatcactttccaatacaacggctcttttcagagccacctactatttctgcgggagagctgggccactggt

SEQ ID NO: 13725 - DNA, 487 bp, Homo sapiens
actcactttctgacttaggccacaggtcgttttaccatgtctggacgtggcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcaacgacgaggagctcaacaagctgcttggtaaagttaccatcgctcagggcggtgttctgcctaacatccaggccgtactgctccccaagaagactgagagccaccacaaagctaagggcaagtaagggctgaactttaaaaatgtaaacttacaagacaaaaggctcttttcagagccaccca

SEQ ID NO: 13726 - DNA, 437 bp, Homo sapiens
atgccggaggtgtcatctaaaggtgctaccatttccaagaagggctttaagaaagctgtcgttaagacccagaaaaaggaaggcaaaaagcgcaagaggacccgtaaggagagttattctatttacatctacaaagtgctaaagcaggtccatccggacactggcatctcttcgaaagctatgagcattatgaattccttcgtcactgatatctttgagcgtatagcgagcgaggcatcacgtttggctcactacagcaagcgctccaccatttcttccagagagattcagacagcagtgcgcttgctactgccgggagagctggctaaacatgctgtgtctgagggcaccaaggctgtcactaagtacaccagctccaagtaagcctgctaagtaaacgtcatttctaacccaaaggctcttttcagagccactta

SEQ ID NO: 13727 - DNA, 431 bp, Homo sapiens
atgcctgaaccctctaagtctgctccagcccctaaaaagggttctaagaaggctatcactaaggcgcagaagaaggatggtaagaagcgtaagcgcagccgcaaggagagctattctatctatgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataagtgcttatgtaagcacttccaaacccaaaggctcttttcagagccaccta

SEQ ID NO: 13728 - DNA, 647 bp, Homo sapiens
gacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaaggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaag

SEQ ID NO: 13729 - DNA, 571 bp, Homo sapiens
gacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatataggaactggagaggggtggggacaagtgttgcagcttagagagg

SEQ ID NO: 13730 - DNA, 789 bp, Homo sapiens
agtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgtaaa

SEQ ID NO: 13731 - DNA, 523 bp, Homo sapiens
gattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaa

SEQ ID NO: 13732 - DNA, 497 bp, Homo sapiens
caaattccgaggatcaggagatgtagatttcattttctttcctaactgcagaacagcaaagatagcatgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagcca

SEQ ID NO: 13733 - DNA, 1195 bp, Homo sapiens
gcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtacgcctgctgctgcccggggagctggctaagcacgccgtgtcagagggcaccaaggccgtcaccaagtacaccagctctaagtaattctaacgtcttcatacccaatcccaaaggctcttttaagagccacccactttttcagctatagagttgtaattacctgcatattttccgtgtttaccaccaacaggtttggttttatcctcatttgagggggttgctgctgtgtaggtctagaccacagttcttttgactggttgaaggaaaatgctatacttaaccgtagcatgtttgttttaccccaagtgctggttagaaggctagcccattgtgctgataagcacatttttcttatgttgtgctgtgatgtgtcccttgtcaaattggtttcataagaaaagaacttttgaaatatctcttttgctactgacatagtgtgagggaaaggaatgtcttccttaattccggtttagtcatcgcagcattggcgaatttagctggttaaaataatgtaatcaaattctttaaaatataaggaaagcaagacaagtaatgtgcatgaaaactgaaaaaatgtgaacacccgagcctggatgcagcactaataatcaacattgttcttggtttagttaaagaaaatttggccactggcaaaataccatttgggagtaatgagacacacccctaatcctaaaatattttcttgtcacttcctcaaagttgtttttgactttttttccttcagggttgacttcatatgtgttcattttattctaataagcaaaagttgtaatttttaagtgaaaaaataatttatgtcattctacttacaaatacaatttttctattctatatactc

SEQ ID NO: 13734 - DNA, 445 bp, Homo sapiens
catgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaa

SEQ ID NO: 13735 - DNA, 425 bp, Homo sapiens
atgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccatcacctccagggagatccagacagccgtgcgcctgctgctgcctggggaactggccaagcacgccgtgtccgagggcactaaggccgtcaccaagtacaccagctccaaataaatggacgcatgttcaaacccaaaggctcttttcagagccactta

SEQ ID NO: 13736 - DNA, 479 bp, Homo sapiens
gcgtttgggctcaccagcattttcctgtggtcatttgacggtatcacttcggctgcgaacatgcctgaaccagctaagtcagctcccgccccgaagaagggctccaagaaggcggtgaccaaggcacagaagaaggatggcaagaagcgcaagcgcagccgcaaggagagctattccgtgtacgtgtacaaggtgctgaagcaggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagtaaactagttacctgggtaaaagcgctaacgacccaaaggc

SEQ ID NO: 13737 - DNA, 453 bp, Homo sapiens
ttggttttgccactattgtttcattatgcccgagctggccaagtctgctcccgccccgaagaagggctccaagaaggcggtgaccaaggcccagaagaaggatggcaagaagcgcaagcgcagccgcaaggagagctactccgtgtacgtgtacaaggtgctgaagcaggtccaccccgacaccggcatctcttctaaggccatgggaatcatgaactccttcgtcaacgacatcttcgagcgcatcgcaagcgaggcttcccgcctggcgcactacaacaagcgctcgaccatcacctccagggagatccagaccgccgtgcgcctgctgcttccgggggagctggccaagcacgcggtgtcggagggcaccaaggccgtcaccaagtacaccagctccaagtaaattctcaagctcttgtccaacccaaaggctcttttcagagccactca

SEQ ID NO: 13738 - DNA, 446 bp, Homo sapiens
atgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccggggaattggccaagcacgccgtgtccgagggcaccaaggccgtcaccaagtataccagctccaagtgagcctctcgctgcagtaacagttccgccgtgacccacaccccaaaggctcttttcagagccgtcca

SEQ ID NO: 13739 - DNA, 449 bp, Homo sapiens
atgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggtcagtctcggcccacaccccaaaggctcttttcagagccactca

SEQ ID NO: 13740 - DNA, 707 bp, Homo sapiens
acgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggaagagaaaaagaagattcacagagagcattaagaaggcccatggattcagaaagctcaagatttggctaaaattaagagtcagcaaccaatctccagatgacatttatattgcaagagattgaatgcagaaagaagaattcagctttcttttattaaacaaggcattagagagatttgcaaaatt

SEQ ID NO: 13741 - DNA, 467 bp, Homo sapiens
attcttgttatttgagtgctctttcactctcctccgccatgcccgacccggctaaatctgctcctgcccccaaaaagggctccaagaaagccgtaaccaaggcccagaaaaaggacggcaagaagcgcaagcgcagccgcaaagagagttactctatctacgtgtacaaggtgctgaagcaagtccaccccgacaccggcatctcatcgaaggccatgggcatcatgaactccttcgtcaatgacatctttgagcgcatcgctggcgaggcttcccgcctggcgcattacaacaagcgctcgaccatcacctccagggagatccagacggccgtgcgcctgctgctgcccggggagctggccaagcacgccgtgtccgagggcacaaaggccgtcaccaagtacaccagctccaagtgagctctcgcagctgccagcaatccaaaggctcttttcagagccactcac

SEQ ID NO: 13742 - DNA, 469 bp, Homo sapiens
atggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttc

SEQ ID NO: 13743 - DNA, 472 bp, Homo sapiens
atggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccactt

SEQ ID NO: 13744 - DNA, 459 bp, Homo sapiens
atggctcgtacgaagcaaacagctcgcaagtctaccggcggcaaagctccgcgcaagcagcttgctactaaagcagcccgtaagagcgctccggccaccggtggcgtgaagaaacctcatcgctaccgcccgggcaccgtggccttgcgcgaaatccgtcgctaccagaagtccaccgagctgctgatccggaagctgccgttccagcgcctggtgcgagaaatcgcccaggacttcaaaaccgacctgcgtttccagagctctgcggtgatggcgctgcaggaggcttgtgaggcctacctggtgggactcttcgaagacaccaatctgtgcgctattcacgctaaacgcgtcaccatcatgcccaaagatatccagctggcacgtcgcatccgtggggaaagggcataagtctgcccgtttcttcctcattgaaaaggctcttttcagagccactca

SEQ ID NO: 13745 - DNA, 411 bp, Homo sapiens
atggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaa

SEQ ID NO: 13746 - DNA, 865 bp, Homo sapiens
acttttacatttttgtcttcattgcttaacatcgtttttaagaattcaaaatgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaaggcagggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaa

SEQ ID NO: 13747 - DNA, 462 bp, Homo sapiens
atggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaacca

SEQ ID NO: 13748 - DNA, 466 bp, Homo sapiens
ctatggcacgcacgaagcaaacagctcgtaagtccactggcggcaaagccccgcgcaagcagctggccactaaggcggctcgcaaaagcgcgccagccaccggtggcgtgaagaagccccaccgctacaggcctggtactgtcgccctccgtgaaatccgccgctatcagaaatcgactgagctactgattcgcaagctaccattccagcgtctggtacgtgagatcgcgcaggacttcaagaccgacctgcgcttccagagctcggctgtgatggcgctgcaggaggcctgcgaggcttacctggtggggctctttgaggacaccaacctgtgtgctatccacgccaagcgagtgactatcatgcccaaggacatccagctcgctcgccgcattcgcggagagagggcataagttgtactgagggtgtgcgccaacttaaaccaaaggctcttttcagagccacc

SEQ ID NO: 13749 - DNA, 467 bp, Homo sapiens
atggcccgcaccaagcagactgcacgcaagtccaccggtggcaaagcgccgcgcaagcagctggccactaaggcggctcggaaaagcgcgccggccaccggcggcgtgaagaaacctcatcgctaccgtcccggcaccgtggctctgcgcgagattcgccgctatcagaagtcgactgagctgctgatccgcaagttgcctttccaacgcctggtgcgagaaatcgctcaggacttcaagacagatctgcgctttcagagttccgcggtgatggccctgcaggaggcctgcgaggcctacttggtggggctctttgaggataccaacctgtgtgccatccatgctaagcgagtgactatcatgcccaaggacattcagctcgctcgccgcattcgtggggagagagcgtagaggtttccgggcagtaattctatccaacttaaaaaggctcttttaagagccgccta

SEQ ID NO: 13750 - DNA, 473 bp, Homo sapiens
ctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccaccca

SEQ ID NO: 13751 - DNA, 477 bp, Homo sapiens
ttagccatggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataaatattcctatcagcccaagaagtctgtccaaccccaaaaggctcttttcagagcccctca

SEQ ID NO: 13752 - DNA, 478 bp, Homo sapiens
atggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgtgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataatcccctgctctatcttgggtttcttaattgcttccaagcttccaaaggctcttttcagagccactta

SEQ ID NO: 13753 - DNA, 339 bp, Homo sapiens
atgtctggacgtggtaagggcgggaagggtttggctaaagcaaaaacttgttcgtcgctaccgggcttgcagttcccaggcagagtccgtcatctttttcgaaagggcaattattttgagccggtcggagccggtgcgccagtgtacttacaatacctggccgccgagatcttagaactggtgggcagcgccatacgtgacaagacccgcagcatcatcccccgccacctgcagctggccatccgaaacgacgaggaggtcaacaagcagctgggcaacgtcactattgctcagggaggcgtcctgtccaatattcaggccgtcctgttgccaaaataa

SEQ ID NO: 13754 - DNA, 372 bp, Homo sapiens
atgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgccca

SEQ ID NO: 13755 - DNA, 357 bp, Homo sapiens
atgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgccca

SEQ ID NO: 13756 - DNA, 415 bp, Homo sapiens
ttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttc

SEQ ID NO: 13757 - DNA, 367 bp, Homo sapiens
atgtctggccgcggtaagggcggaaagggtctaggtaagggtggcgccaagcgtcaccgtaaggtattgcgtgacaatatccaaggaatcaccaagcccgctatccgccgcctggctcgccgcggcggcgtcaagcgtatttctggcctcatttatgaggaaactcgcggagtgctgaaagttttcctggaaaatgtaatccgcgatgctgtcacctacacggaacacgccaaacgcaagacagtcacagccatggacgtggtgtacgcgctcaagcgccagggacgcactctttatggcttcggcggctgagcttacctctacagtacactaccgcaaaaccaacggcccttttcagggccaccta

SEQ ID NO: 13758 - DNA, 1409 bp, Homo sapiens
gttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctctttataagttaattgttcctgtcaacaggtacgtatatttttcagccgttttttttttttcgttccaaattacatttggggtttcggcatacgattttttaggctacgatccttttatgtttattgtagtagggccttagattgcactgaaaaggctagggtaatagtgtctgtttaccttaccacttttattttgagtacctaaaaatgcatggttttcgacataagtgggaaaaccgcaagacactgcgtaaccgctcaaaatggcggagagcgaagaacaaagccggtgcctggcaatgggccggacccgcgaattagcgcaaccaatcatcttcctggaaaggagtgtgggccttaaattctagcggcctgttttctattacttaacctaacgaccgagtttaggtgtgtagaagttcctggggtagataagctcacgcaaggagaggttgcaagcattcatttcggaattctattaagccaacccagttgtcccttagaagttatgatatttgctgttttttgaataaaagaatttgactctctttaaaccctaaagcttgaaatttagcatttatctcacatgagacaaatgtttaggaactcatgtttaggaactcatgttcctgcctgaggcaggaactgaaacaccagatcacttgcatcgagaccgtgagactccctatgtttcatccatcatgattgcgtccttatccctccctgatttcctgttttctcgcccttctcgctacataagccccccaattttggtcggggagacggatttgtgatttcatctcctccctcatgaatactcatagaatttttccaaacctactgaatctgtatgtaaggttgactctgtaaggcatatatatattccagctccccttcactgccacagagcgctcattccatcctgggattacttctccctctgaaaataaagtctttgttacttcctg

SEQ ID NO: 13759 - DNA, 416 bp, Homo sapiens
tcagtctccaaaaaggtccgcataattgatatataaggggcttcagtgtgtagcaaagttgcaaaagttaagagttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccg

SEQ ID NO: 13760 - DNA, 374 bp, Homo sapiens
ggctgcggaaagcgagtaatcgttttgtttagagatagttctgacttgtttatcatgtctgttcggggcaaggccggaaaaggccttgggaaaggcggtgccaagtgccatcgcaaggtactgagcgataatattcagggcattaccaagtgcactatccggcgcttggcccggcatggcggtgtcaagcgcatcttgggcctcatttatgaggagacccgccgggtgttcaaggtgttcctggaaaatgtgatctggtacgccgtgaccaacacggagcacgccaagcgcaagacggtcaccgccatggccgtggtctacgtgctcaaacgccagggaagaaccctgtaaggctttggcggttaagtgaggcc

SEQ ID NO: 13761 - DNA, 1034 bp, Homo sapiens
aggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcagttctgtggctcctgatggatctgagaagatggacgtggaggatgaaaatctgtctgattattttgaactgatgtttgttgctatggagatgctgcctatatgttgatgttgcagacgttaagtcactagcccacagccttgtattccatactcagagaccctgctacttacttgacatctcaacttgaaagtccaattaatatgcacttcaaactttaataggcttcaaacagaatttctttcattatctctgcaaaacagcttctctcatcatcttgaaattagtgaatggcattttactgttttagttggagtcatttctgtggttttctttcacatcctacataacaatccatcagtaagttctatgagctcttctttgaaaacaaacagaatccaactgtttcattcccacttctgctctggtcaagccactgccaacactcacctttattattgtagcaccctcattgcctagttctgtcccacagatttccaataaaaggtgaataaaatcaggtcactcttctgct

SEQ ID NO: 13762 - DNA, 397 bp, Homo sapiens
ttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaa

SEQ ID NO: 13763 - DNA, 1343 bp, Homo sapiens
gaccacttgataatgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctcatctatgaggagacccgcggagtgttgaaggtgttcctggagaacgtgatccgggacgccgtgacctacacggagcacgccaagcgcaagacggtcaccgccatggacgtggtctacgcgctcaagcgccagggccgcaccctctatggcttcggcggctaaatggcattttgaagcccagtcattctctaaaaaggccctttttagggcccctaagctttcaacaaaagagttgaaatgactgcaaactgagtctcttaatagggccattgtcagtgagttctgtcatcctattttacaagattaactcgacgccgaaaatgggctgatgactacaggtgaccttgggccgagatttttccaaggccagaagagcctctgctggccagtaacttctggcggctgcctggaaattgcctgcagccggtttaccgctcggattagtttagaaagccaaggggtctgcggtccaaataggggcgggctagataattaacttccctctggaccttcaaatacgtctcaggagataatgagtttgatgggctccactaaatgctagaacctccaggaaaacttcgtggtggctggtttaagaggacttggcgggcacagagctctgcatgggggggagggggacagaccatgcttttactactgtagaacagtagggcagtcttaagagtcttagtaataatattcctttatatgtttgccttttaaatactggaatatatcaagtatacaaaatgcgctggtgaccacaccacttattcaagtgcatctaaaatccttatgtccctttctcagtagcacagccctccctttttcctatctagaattaactaatattctaggataaactgatattctaaatttgtttactgttcccacgcgttttaactttagatgcacatacccctaatctattttaatcgtcatgaatttttacatttgctcttgaaatatatccgtgttgaaatgtgcagttctaggttatttttaccattaatctagttttctaatgtgtcagtaaatactttattcatttctctgttgattttttttcctcattacaaaacagcactgtatacagctgtgcattttctggttacatggaagtggaattatttggtaaatgtgcatattcaacatgaataaaaatgaacaatttgctttcc

SEQ ID NO: 13764 - DNA, 374 bp, Homo sapiens
gagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaataaaaggcccttttcagggccaccct

SEQ ID NO: 13765 - DNA, 354 bp, Homo sapiens
atgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaacaaaaggccctttttagggccccca

SEQ ID NO: 13766 - DNA, 364 bp, Homo sapiens
catgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctgagtgttttacttacttacacggttcctcaaaggcccttctcagggccaccca

SEQ ID NO: 13767 - DNA, 437 bp, Homo sapiens
atgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggccggcgcgcccgtctacatggcggcggtcctcgagtacctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgttttgcctaacatccaggccgttctgttaccaaagaaaaccgaaagccacaaagccaaaagcaaataaatgcagacaaacaaaccaagaccaaaggctctttttagagccaccca

SEQ ID NO: 13768 - DNA, 2223 bp, Homo sapiens
acttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 13769 - DNA, 1656 bp, Homo sapiens
cgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaagctgtaccgcttgccctccgtgctcctccggcattagagcggggaaggcacttccgcttaggctcccaacaaaacggggtcgggtccccctgctgcggtgccgtcttgagctttgccgacttcggccaattggcctatccgcactggccgggctgcggacgctttcctgggcgccggctcgcgggctttggcggtccggctccccccgcgcgtgaccggggccctgcgtggcgggggggccggggcaggagagacggggcgtcgggcacgaggccaggggtcactagggggacgctcagggctcgcggtcctgagcgcggctggcctttgcggaagtggagcgccacacgcccgtgcttcgcgcccaaaccggcctcacccggcgcggccatccggctagggagggaaatgaccacctcggcctcgccggggttctgcggacaaacgtggggagaactgcgctggggctgccgttcagtccccgcgccacctccactagcacagtggtaacccccatatcctgcccctaagccaaaattcccgggggcacggggtgtgggcggaattttgtgaatctgggctttatcgagccgttccctgtccatgtccacagaaggagattcactattccagtgaaggcactcggtcctcttagaagctgcatggtatgtctggattttctgtccagactcagtagttcctttacgttgttttcgtcggacatgtgggcagacgctggtgcccgagttcagatccttgggaagacagtagatcagacaggaagaacgtgggcctccgttgggcaaatgaagctcttcgccttaggaaatcgtgacaggaggccacagaggtgatctctacagtctctgggagctgggaagtccaaggcctcttagtgggaaagtgaggcagggtcttgcagagcccactctacacacggccagatacaaatggctgtagaggtcttagataacaccttctcggtcatttatttgcacctcagaagaagccagggcttcggttttctgtttgtttcatcacagttgacaggttaaaagcattcactgcagcgatctatgagaattaagaggggagaaggggaaatggaataaaacttcgttttgtaaagct

SEQ ID NO: 13770 - DNA, 481 bp, Homo sapiens
atggcccgaaccaagcagactgcgcgcaagtcaacgggtggcaaggcgccgcgcaagcagctggccaccaaggtggctcgcaagagcgcacctgccactggcggcgtgaagaagccgcaccgctaccggcccggcacggtggcgcttcgcgagatccgccgctaccagaagtccactgagctgctaatccgcaagttgcccttccagcggctgatgcgcgagatcgctcaggactttaagaccgacctgcgcttccagagctcggccgtgatggcgctgcaggaggcgtgcgagtcttacctggtggggctgtttgaggacaccaacctgtgtgtcatccatgccaaacgggtcaccatcatgcctaaggacatccagctggcacgccgtatccgcggggagcgggcctaggagggctatctcgccacctgagaggttgcgcaacgttcaccccaaaggctcttttaagagccacccacct

SEQ ID NO: 13771 - DNA, 5327 bp, Homo sapiens
cgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggcagatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccccccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgcc

SEQ ID NO: 13772 - DNA, 5069 bp, Homo sapiens
cgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccccccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgcc

SEQ ID NO: 13773 - DNA, 5324 bp, Homo sapiens
cgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcggggatgccgttctgagtgcctgactgcctcgccccgaaggatggcctcggatgggcattagaggcacggcggccccgggctcccgtcccgtccgtctgtctgttatcgtctgtctctcttgacatcaccgcagctccaccccctcccgtcccagcccccaacgccagcttcctgcaggcccagagccggcatgaactctcccaacgagtcggatgggatgtcaggtcgggaaccatccttggaaatcctgccgcggacttctctgcacagcatccctgtgacagtggaggtgaagccggtgctgccaagagccatgcccagttccatggggggtgggggtggaggcagccccagccctgtggagctacggggggctctggtgggctctgtggaccccacactgcgggagcagcaactgcagcaggagctcctggcgctcaagcagcagcagcagctgcagaagcagctcctgttcgctgagttccagaaacagcatgaccacctgacaaggcagcatgaggtccagctgcagaagcacctcaagcagcagcaggagatgctggcagccaagcagcagcaggagatgctggcagccaagcggcagcaggagctggagcagcagcggcagcgggagcagcagcggcaggaagagctggagaagcagcggctggagcagcagctgctcatcctgcggaacaaggagaagagcaaagagagtgccattgccagcactgaggtaaagctgaggctccaggaattcctcttgtcgaagtcaaaggagcccacaccaggcggcctcaaccattccctcccacagcaccccaaatgctggggagcccaccatgcttctttggaccagagttcccctccccagagcggcccccctgggacgcctccctcctacaaactgcctttgcctgggccctacgacagtcgagacgacttccccctccgcaaaacagcctctgaacccaacttgaaagtgcgttcaaggctaaaacagaaggtggctgagcggagaagcagtcccctcctgcgtcgcaaggatgggactgttattagcacctttaagaagagagctgttgagatcacaggtgccgggcctggggcgtcgtccgtgtgtaacagcgcacccggctccggccccagctctcccaacagctcccacagcaccatcgctgagaatggctttactggctcagtccccaacatccccactgagatgctccctcagcaccgagccctccctctggacagctcccccaaccagttcagcctctacacgtctccttctctgcccaacatctccctagggctgcaggccacggtcactgtcaccaactcacacctcactgcctccccgaagctgtcgacacagcaggaggccgagaggcaggccctccagtccctgcggcagggtggcacgctgaccggcaagttcatgagcacatcctctattcctggctgcctgctgggcgtggcactggagggcgacgggagcccccacgggcatgcctccctgctgcagcatgtgctgttgctggagcaggcccggcagcagagcaccctcattgctgtgccactccacgggcagtccccactagtgacgggtgaacgtgtggccaccagcatgcggacggtaggcaagctcccgcggcatcggcccctgagccgcactcagtcctcaccgctgccgcagagtccccaggccctgcagcagctggtcatgcaacaacagcaccagcagttcctggagaagcagaagcagcagcagctacagctgggcaagatcctcaccaagacaggggagctgcccaggcagcccaccacccaccctgaggagacagaggaggagctgacggagcagcaggaggtcttgctgggggagggagccctgaccatgccccgggagggctccacagagagtgagagcacacaggaagacctggaggaggaggacgaggaagacgatggggaggaggaggaggattgcatccaggttaaggacgaggagggcgagagtggtgctgaggaggggcccgacttggaggagcctggtgctggatacaaaaaactgttctcagatgcccagccgctgcagcctttgcaggtgtaccaggcgcccctcagcctggccactgtgccccaccaggccctgggccgtacccagtcctcccctgctgcccctgggggcatgaagagccccccagaccagcccgtcaagcacctcttcaccacaggtgtggtctacgacacgttcatgctaaagcaccagtgcatgtgcgggaacacacacgtgcaccctgagcatgctggccggatccagagcatctggtcccggctgcaggagacaggcctgcttagcaagtgcgagcggatccgaggtcgcaaagccacgctagatgagatccagacagtgcactctgaataccacaccctgctctatgggaccagtcccctcaaccggcagaagctagacagcaagaagttgctcggccccatcagccagaagatgtatgctgtgctgccttgtgggggcatcggggtggacagtgacaccgtgtggaatgagatgcactcctccagtgctgtgcgcatggcagtgggctgcctgctggagctggccttcaaggtggctgcaggagagctcaagaatggatttgccatcatccggcccccaggacaccacgccgaggaatccacagccatgggattctgcttcttcaactctgtagccatcaccgcaaaactcctacagcagaagttgaacgtgggcaaggtcctcatcgtggactgggacattcaccatggcaatggcacccagcaggcgttctacaatgacccctctgtgctctacatctctctgcatcgctatgacaacgggaacttctttccaggctctggggctcctgaagaggttggtggaggaccaggcgtggggtacaatgtgaacgtggcatggacaggaggtgtggacccccccattggagacgtggagtaccttacagccttcaggacagtggtgatgcccattgcccacgagttctcacctgatgtggtcctagtctccgccgggtttgatgctgttgaaggacatctgtctcctctgggtggctactctgtcaccgccagatgttttggccacttgaccaggcagctgatgaccctggcagggggccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtggccacgctagagaaagtcatcgagatccagagcaaacactggagctgtgtgcagaagttcgccgctggtctgggccggtccctgcgagaggcccaagcaggtgagaccgaggaggccgagactgtgagcgccatggccttgctgtcggtgggggccgagcaggcccaggctgcggcagcccgggaacacagccccaggccggcagaggagcccatggagcaggagcctgccctgtgacgccccggcccccatccctctgggcttcaccattgtgattttgtttattttttctattaaaaacaaaaagtcacacattcaacaaggtgtgccgtgtgggtctctcagccttgcccctcctgctcctctacgctgcctcaggcccccagccctgtggcttccacctcagctctagaagcctgctccctctgcagggggtggtggtgtcttcccagccctgtcccatgtgtccctccccccattttcctgcattctgtctgtccttttcctccttggagcctgggccagctcaaggtgggcacgggggcccagacagtactctccagttctggggccccccgagtgaggagggaacgggaagtcggtgccttggtttcagctgatttggggggaaatgccttaatttcactctcctcccttctccagcctcaggggaggatctggaggatccactactgtctttaagatgcagagtggaggggaggtgggcacccaccctgcgattctccaccctttccccttctttcgtcctcaccatctctgcagacccctctcctcctccttcctcttggtctcagcactgatgggaggctggtgcccaagctgtggcctgcagtctgtgaggagggctgtcttgcctcacactcctcacagcctacttccccttccccggggctgagagggtgaaagtgtgtggggaaggagaggactggtttcctgggttctcaggggccaggaggagtaacagaaccaggtctgctccccaccttactcggatggcctccctgcccctctgctggcacagcctgggcaaggggagaaggtggtccctgcagaggggctccaggctggtgagagcccccctgctgtcaggaccagattttcccagccatccagcatgctgcggggagaaggggcagaggctcacctccctcctggggccttttgttttggatcctggggatggtgagaatggaggttctagaaggggtaaggccagaacccagggatccaggagtcggctctcagctggagcttccataccttctgggctccctttgctgaccaccagcccaagggagctaagaccaggagggggctgggcgctgtcccttctctttcccaggagccctgccaggggctgtgggcctacaaggcttccaggggatgccatccagcctgtaggaaaccaaagatgggaagtggctcctagggggctgactcttccttcctcctcctccccagtaccacatatactttctctccttctatctccagggccccaccaatctgtttacatatttattatcctatgggggcctgagcaggattgagggagccaggggaggggcaggagtcccagcaccatcggttcatagtgtgcttgtgtgtttgttttagatcctcctgggggatggggatggggccaggctcagtgtactaggcctctctgtgctgagccccaggctcccggccccttacccactctctccctgtggctggtctggttctcatgtaaacccactccttgctttgtctccctggatatggatttcagttaagtattttgtaacccgttacactgtgtgtccttgtgtaaataaacttgtttctggcagtgcc

SEQ ID NO: 13774 - DNA, 2533 bp, Homo sapiens
gcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagtctcgatctcctgacctcatgtggaaccttgtaccatgggtgctattctgtggctgctgtaggatcttcccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatcta

SEQ ID NO: 13775 - DNA, 2834 bp, Homo sapiens
ctccacaaactgagttctttagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaacctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacattt

SEQ ID NO: 13776 - DNA, 3254 bp, Homo sapiens
atggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaatt

SEQ ID NO: 13777 - DNA, 4239 bp, Homo sapiens
ggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaaga

SEQ ID NO: 13778 - DNA, 4102 bp, Homo sapiens
gcactgagcagtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaaga

SEQ ID NO: 13779 - DNA, 4659 bp, Homo sapiens
ggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaattctgaacagcagcttcacttgttctttggatggacttgaaagggcattaaagattccttaaacgtaaccgctgtgattctagagttacagtaaaccacgattggaagaaactgcttccagcatgcttttaatatgctgggtgacccactcctagacaccaagtttgaactagaaacattcagtacagcactagatattgttaatttcagaagctatgacagccagtgaaattttgggcaaaacctgagacatagtcattcctgacattctgatcagctttttttggggtaatttgtttttcaaacagtcttaacttgtttacaagatttgcttttagctatgaacggatcgtaattccacccagaatgtaatgtttcttgtttgtttgttttgttttgttagggtttttttctcaactttaacacacagttcaactgttcctagtaaaagttcaagatggaggaactagcatgaggcttttttcagtatctcgaagtccaaatgccaaaggaacctcacacactgtttgtaatggtgcaatattttatatcacttttttttaaacatccccaacatctttgtgttctcacacacaggcaatttgcaatgttgcaattgtgttggagaatgaagtccccccacctcccagccacacacacatcctttgttctcatgacagtaggtctgagcaaatgttccaccaagcattttcagtgtctttgaaaagcacgtaacttttcaaaggtggtcttaatttgttgcatatctatcaaggacttattcactcacctttccttttctgccctctatcaattgatttcttcttacctttcatcattcattccttcctttagaaaaactgaagattacccataatctcctcttattacttgagggccttgactatttagtttattttgtttactttacaggttaacacagttgttttgtctgattgcattttattaactgtgaagccgttgaaatgaatatcacttaagcaacgttgctaaatttctatgtgtttgaaatgtgttaatgaaggcactgcttatttgtagtcaccttgaactgacttaacctagaagctgtgccttcttgtgaaaaaaaaaaaaaacaaaaacaaaaaacagcctttaaacaagtttccttagtgtcaaaagttaaaaataaa

SEQ ID NO: 13780 - DNA, 799 bp, Homo sapiens
gctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcag

SEQ ID NO: 13781 - DNA, 550 bp, Homo sapiens
aatattataacggatacagaaaagttcagaaggactgagctagtttgcgaaaccacagcacactttggcaaagagggaatgcacaacaaaacggatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaa

SEQ ID NO: 13782 - DNA, 2524 bp, Homo sapiens
gcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctgacctcatgtggaaccttgtaccatgggtgctattctgtggctgctgtaggatcttcccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatcta

SEQ ID NO: 13783 - DNA, 2359 bp, Homo sapiens
ggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggt

SEQ ID NO: 13784 - DNA, 3099 bp, Homo sapiens
atgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacattta

SEQ ID NO: 13785 - DNA, 602 bp, Homo sapiens
gagtatacttagagtatggagctgacaaacattctctttccttctcctcctcctcctcctcattctgttgaattgctggtttctgtagtctattaggcttcttattaatagtaataaaatgttcattcattaactctctcatgcctgcataccagctatagtaactgtctttgcccccaagttatgcagtctttataaagtcgttcagtagcagggcaatgagttgggaaaactgatattgcatctgtagcatcaggtactatttaaccagtgggagggactgataaaattagcaagttgactaaccacttcccttccttgtggctctttaatattataacggatacagaaaagttcagaaggactgagctagtttgcgaaaccacagcacactttggcaaagagggaatgcacaacaaaacgggagtacctggtaaaatgctgtggtgtatggagacagttatgagaaactggagggaggatgatagttgagatggggtggctggacgagagcagctcttggctcagcaaagaatgcacagtatgatcagctcagtggatgtgaagtcagaagttcctgtgggcctggagcccatctcacc

SEQ ID NO: 13786 - DNA, 3210 bp, Homo sapiens
atgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcagaactgctggtgagcctatggaagaggagccagccttgtga

SEQ ID NO: 13787 - DNA, 2307 bp, Homo sapiens
ctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattag

SEQ ID NO: 13788 - DNA, 2199 bp, Homo sapiens
tttatcaatgggtaggtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctgggctgcccaccacacatcattggatcaaagctctccaccccttagtggaacatctccatcctacaagtacacattaccaggagcacaagatgcaaaggatgatttcccccttcgaaaaactgaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactg

SEQ ID NO: 13789 - DNA, 2927 bp, Homo sapiens
gctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttc

SEQ ID NO: 13790 - DNA, 2772 bp, Homo sapiens
caggcgcgttaagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcaccct

SEQ ID NO: 13791 - DNA, 2081 bp, Homo sapiens
acttccggtcggtggcccaggcgcgttaagctggttgggacccgggaaggcctccctcttaaggtctttcccacacctctgcaccttgttacctgactttcggcttcaggatccgcagcgtgcacccgcgttccgcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgag

SEQ ID NO: 13792 - DNA, 2757 bp, Homo sapiens
aactgacgtgctgagcagctaattcagtgcctgaggttacactagttgtggacagagatgggttccaaatccagatagtatgggttgaatccacgctcttcatcaccacccactttccctccttaggcctgagcaggcacgtggcagcatttggtagaggaaggagtgagccctgctgtaggaactatatatattggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctc

SEQ ID NO: 13793 - DNA, 2750 bp, Homo sapiens
aagctggttgggacccgggaaggcctccctcttaaggtctttcccacacctctgcaccttgttacctgactttcggcttcaggatccgcagcgtgcacccgcgttccatctgtcttctgagactttgcccttctccaggaagagcactcaggagaccaggaaaatggccacagggctcctgagagccaaaaaagaggcgttcgtggcattcagggatgtggctgtgtacttcacccaggaggagtggaggttgttgagccctgctcagaggaccctgcacagggaggtgatgctggagacttataaccatctggtctcactggaaattccatcttctaaaccaaaactcattgctcagctggagcgaggggaagcgccctggagagaggagagaaaatgtccactggacctctgtccagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctaccc

SEQ ID NO: 13794 - DNA, 2854 bp, Homo sapiens
gggtctgcagatggcgtccgagtgcacagtggccagtgtgattccgcagtcttgggctgttcggccaagcgcccaccggacgtgggacgctggagggtcagcagcgtggagtcctggccttcagcgtccgcggctgggaaatcggccatcgccacggcgggaactaggactggctgcgtcccggcccttccccatccgtccaccggactcgtgggcgcccgcactgactgtgatgtagtttcctgacctctgacacgtattgtctcaagattaaaggaatcaggagcttcttttgctgttcttctgttttggatgcattggaaggtccagatttggaacaagtctctctagagattgaacagagctgcgcctggaacccgccgcagggaggagacctgaagaccagaggaaacacagcaaaaattccatcttctaaaccaaaactcattgctcagctggagcgaggggaagcgccctggagagaggagagaaaatgtccactggacctctgtccagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctc

SEQ ID NO: 13795 - DNA, 4047 bp, Homo sapiens
cttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttatggaagtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaa

SEQ ID NO: 13796 - DNA, 2178 bp, Homo sapiens
gcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctata

SEQ ID NO: 13797 - DNA, 5423 bp, Homo sapiens
agctccaatgtaaacagaacaggcaggggccctgattcacgggccgctggggccagggttgggggttgggggtgcccacagggcttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaacttcttgcttgtccacaaatcattcagatggggtttgggcaggtagcgggaggctggggcaggccagaggcctgcgaagaggagacaggctccagcacccacgctctcacaccccacatctctgcttttcttgctctgctgagactctaatgacaaagccagatttcatcttaacctcaagcttctactttttaaaaaaattttgttttggagacagggtctcactgtcacccaggctggactgcagtggcattatacagctcactgcagccttgaactcctggactaaagggatcctcccacctcagcctcacaagcagcctcacaggcgctcactaccatgcccaactaatttttgtattcttttttttatagagacgaggtttcaccatgttgcctaggctggtctggaactcggctcaagtgatccacctgcctcggcctcccaaagtgctgggattacaggtgtgagccaccatccctggccatgagcttctacttcttttctttttctttttctttttttttttttgagatagggtcttgctccattgcttaggctagagtgcagtggcgcaatctcggctcactgcaacctgcacctcctgggttcaagcgattctcccacctcagcctcctgagtagctgggattacgggcgtgtgtcaacatgctcagctaatttttgtatttttagtagagatggggtctcgccatgttggccaggctggtctcaaactcctggcctcaattgatccacctccttggcctctcaaaatgcttggattacaggcatgagccactgcacccggccacaagcttctacttcttgcagaatgcctttgtcccatgaaacctagtccacgagtgctatgacacttcctgaagtcttgggtggggtgaacgcacaaatcctgggggtgtagagaggaggaggatgtttacttaaaatgtcttaaggttcagcattgacagagaggcaatatccaaatcactctaagttttgttttgggtcctctgacaattgagtttccataatctggtcggctcagagacaccatcatgtgtggtatattcacaaatgcagacaaagaaaattctagaaagccaggggtgaaaaagctctcctttctcagacgattctgtgaagtctatgtgggctaaggagagaagaacaaaagtttctctgggccttggcctcttggggatcccttctctcattttctaaaaactgtttctcacaccaggctaaggaggtggtggggaaggtctcccttcccctgcccacctcagacagttctagggagatggaggtttcaccacttggccactagtctcaaataactggaaggttccttttttcctgaggtcatgaaatgttctggaaccacagcgcccccgccagccctccgtgggagcacagaggggcaggccttgattggtcttctcaccctacagccacttttttggcccaactctcgagcaagccttcatcaccatcagggtctcatgggcagtctgggtttgccagcccagtccttgaacttggagagggaggtggggcttggaaatgccttgtccccagggtgggggggacaccttgtccttggagctggctgagccctgtgcccatggctgggttcagtttgcaggtatagctgtagcactctttgctggtgggaatggagaggtctcgctggccttctttgcctttttcttctttttggtcccaagcgacacctggtccccgttgagctcacctgacttctgcttctggactgtggccatgctggtgggggtggtggcagcgacagccgagtcgacactggccaccttcttggctttctttttcaacttccttttcttctttgcctccttctccactgttccagggctgtggatggctgactcctgtaggatgtcggacgccgacacagctgcctcccggcaccgccgccactcctcgtcactgtcctcactgc

SEQ ID NO: 13798 - DNA, 1742 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtactccagcaatggccagagccacctgctgccatccaaccacagcgtcatcgagaccttcatctccacccagatggcctcttcctcccagtaa

SEQ ID NO: 13799 - DNA, 1589 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggtaagctggtggggatgggtgggcacctgggtgggaggctcatggggcaaccgcagaatccaggagctggaagagccactgggactcattcattcattcatcaacatgtatttatccagtgcctactctggaccagtcactgtgctacatcagtgatacctggagactccagcaatggccagagccacctgctgccatccaaccacagcgtcatcgagaccttcatctccacccagatggcctcttcctcccagtaa

SEQ ID NO: 13800 - DNA, 3032 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13801 - DNA, 2671 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13802 - DNA, 1649 bp, Homo sapiens
cagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgc

SEQ ID NO: 13803 - DNA, 3039 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaa

SEQ ID NO: 13804 - DNA, 3332 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtaaggtccaggcctgctggccctcccttggcctgtgacagagcccctcacccccacatcccccgggctcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaa

SEQ ID NO: 13805 - DNA, 1594 bp, Homo sapiens
cagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaataggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacggtgagcgccctgtgccccacacagcaggagatgatgatagaggttggctgtcaatggatgcaggggaaaggggtgcctggcaggcattgcagtctgcatgtgtctctgggacaagtgtgtttccgtgattgagggtgtctgcaggccagtgtgttcccatgtgaatgcacgtatctgtgtgtgtgcacgactgcttgtgtgagcagatccctagtgc

SEQ ID NO: 13806 - DNA, 2819 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13807 - DNA, 1493 bp, Homo sapiens
cagtgggtgcaaggagtttggtttgtgtctgccggccggcaggcaaacgcaacccacgcgaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggtaagctggtggggatgggtgggcacctgggtgggaggctcatggggcaaccgcagaatccaggagctggaagagccactgggactcattcattcattcatacaacatgtatttatccagtgcctactctggaccagtcactgtgctacatcagtgatacctgggtgaaccaaacagaccaaaatctcagcaactcaagcagggaggcaggcactaagcataatacatcaattctgtggtacctcagaaggtgaagggtctatgggcaaattacagcagggtaagggggactgatgttttctaagtttttgttttatgaagaaaaattaagcccagaaagcccttatttgcaggtacaattatgcagaagcccagtacataagatagataaggagctgctaggagaggggagcagagaactgac

SEQ ID NO: 13808 - DNA, 1352 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgcagcttgtagccagccggggcgagtggcacgtttatttaacttttagtaaagtcaaggagaaatgcggtgg

SEQ ID NO: 13809 - DNA, 2014 bp, Homo sapiens
ggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggagga

SEQ ID NO: 13810 - DNA, 1936 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13811 - DNA, 1493 bp, Homo sapiens
aaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctgcccttgtttggggcaggagtagctgagctcacaaggcagcaaggcccgagcagctgagcagggccggggaactggccaagctgaggtgcccaggagaagaaagaggtgaccccaggg

SEQ ID NO: 13812 - DNA, 3030 bp, Homo sapiens
cttggctagtggggttttgggggggcagtgggtgcaaggagtttggtttgtgtctgccggccggcaggcaaacgcaacccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccagcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtgg

SEQ ID NO: 13813 - DNA, 3050 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccaca

SEQ ID NO: 13814 - DNA, 2885 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagcctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagcc

SEQ ID NO: 13815 - DNA, 2792 bp, Homo sapiens
ctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccagtgtgcaggtaacagagctggaagggatgtacgtgtgactccgctgccttcactggcctcacctgccgtgcctgcccccggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgcctggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagcc

SEQ ID NO: 13816 - DNA, 5706 bp, Homo sapiens
acgagagggcgcagcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacagttcggtttttgcccactagggatgatgtggtttctcatgaggttacttgctctaaaggactttatattttggaaccataagagcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtg

SEQ ID NO: 13817 - DNA, 6466 bp, Homo sapiens
ggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacaggtgcacgctaccatgcccggctaatttttgtatttttagtagaggcgggggtttcaccatgccatccaggctggtttcgaactcctgacctcgtgatccacctgtctcggcctcccaaagtgctgggattacaggtgtgagccaccgcgcctggccctgtattttcaaattctttacctctgcgtttccagccttgctccatccaatttgttactagagctttttaacaatttcacgttgaattaagatgatttggaagaggagaaacaagagtcagaaaaattagcagcatccgtgatctgactctgggtaccagtgggttgttgagatttctgttccccactcactgcagagctgctgcctgccaatgccccctgttgggcagggccacctgtgctagtttaacctggggtctttcactcccggactgcttcttggatgtgagttttaagttgagcagagaagatatgccttgcctgctgccatacattgtaacatcaagtcaagagctttagttacttaacagatttctgctggctgctattataggaggaaactcctttgtttagggacagccagggcttccttagctttgatctttgggagtgagccttttgcttgacttcccttctcttttccatgcctttgtttccatctcgaagtgcaaatttaaagtgtcctgtttgcctttatccactggaaggcaaacaccctggacgacgtatcagtgacagcgcggttctgctttgatcggagcacccagcgctgcttgaaggcgtttgcatggtccatggctcatggaccacgctcctagaaaacggaaatgcacttagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggagggggccccgttgagcattatcacctccatctgtctagttgccacgagtgtctggaacttgagaacagcaccattgagtcagtcaagtttgcgtctgccgagaacattccagaccttccctacgattatagcagcagtttggagagtgttgctgatgagacctcccccgaaagagaagggaggagagtcaacctcacgggaaaggcacccaacatcctcctctatgtgggctccgactcccaggaagccctcggccggttccacgaggtccggtctgtgctggccgactgtgtggacattgacagttatattctctaccacctgctggaggacagtgctctcagagacccgtggacggacaactgtctgctgttggtcattgctaccagggagtccattcccgaagacctgtaccagaagttcatggcctatctttctcagggagggaaggtgttgggcctgtcttcatccttcacctttggtggctttcaggtgacaagcaagggtgcactgcacaagacagtccagaacttggttttctccaaggctgaccagagcgaggtgaagctcagcgtcttgagcagtggctgcaggtaccaggaaggccccgtccggctcagccccggcaggctccagggccacctggagaatgaggacaaggacaggatgattgtgcatgtgccttttggaactcgcgggggagaagctgttctttgccaggtgcacttagaactacctcccagctccaacatagtgcaaactccagaagattttaacttgctcaagtcaagcaattttagaagatacgaagtccttagagagattctgacaacccttggcctcagctgtgacatgaaacaagttcctgccttaactcctctttacttgctgtcagctgcggaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaatgccgggcgtccccgagacgcggctgcctgtccgtgcccatgcatctggaaatctaatttagagttgtaggtgaattttcttttcctccaattcatttgttaagtctttgttctttttctgtgtttctgtttgtttttaggtttgttttgttgtcgttttctttggtgtttgaagaggctctgggatagatggttaagaagtagaaaatttagtttagggaaagccctcccacaggtgggaaattgctctcccctctgtggcttggacttacgtttattgtcaaggggagtttttacatggaaatgacaatgggaaaattcagatattttcttagtagtgcagacctttacccctagtctatgaaaaaacaaaccaaaatatgctcttgcgcccaggccagtggtgagttagaggtatgctatcactgtttgtaagcatctggggaggtactgaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctgtgcattgagtatcgaccgtattttgtaaaaggcaagatatcctcccttccaggctggtaacgggtttcaaggggactcttgaggaagtgccccctaaaatagaacacagcaataactgggcttcctgtccccacccccaccccagcagtgctctctggcactgggaactctgctagggagtggtggaagtaggaaggatttgtgtgcaaaggaaaatcgtggttgagtttcactgcagcaggctgacgttgcctgatgtgagagcaagtggccgactggggtgcgggtgcacaggtcgggggagcacaggccacagagcgcagcctctgggggtcccccaaggcacagcatatacagcatggtcgccccttgccctggagtctgggaacaaagagaggagccagcctccccgcactgcttcagatggaaaagggaggcagggtgggcttccgttctccagatctgtttgctcttaacaggcagaacatgggagaatccttattcctggttaatcactatgcatatttgaaataaaagaaagcgtaagcctctgcaattttaacttctcaaaggatgtctctgaaaagaatcactttaaaccaatgcctataaaaagcaagtctaccaaaataaactaagactttctatgtg

SEQ ID NO: 13818 - DNA, 702 bp, Homo sapiens
catgctcatcacgctgtgctacctgtacctgtgggcgcgctggggtcgccggccggctgagctcgtgcgcgccacggtgcggcggctgcgtgcctcgcgctgttccttcaccttctgcggcgcggccgcgcagcccccgggcgcccgcgtgtgcctgagccgtggcggccgcgtcttctgcgtcagcgacagccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctgg

SEQ ID NO: 13819 - DNA, 666 bp, Homo sapiens
agcgcggcgcggcagggattcgcgggcgaccacccggcgcaggagcggccgcgtttcggcctcagaatccattgaagacttgaacaagtgggccctatttcttgtgtctccttttatacttgaagcagaacacatagcatttgtgacggagagcatttgggtacaaagtgagaatttacagagatcatcctcttcagaaacaacggagtgtcgttctgtcgtccaggctggagtgcagtggtgtggtctcggctcaccacaacctctgcctactgggttccagtgattctcctgcctcagcatcccgagtagctgggactacagattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggaga

SEQ ID NO: 13820 - DNA, 780 bp, Homo sapiens
ggccgcccggggctctggggactcgggtgtccaggtgccgaagtcgccgcttccacgggggactcaggcccgtgagtgggtttcctaagaacttaccagattccacggctcgggtttcctgccttggatcctgctttttattccccagggggagttatttatagacaggaatcgtgtgttcaaggcctggctcttcggactcggcgtttttcttgttcgaggtgcttcaatgggggctggatgccatcatcttccagtccattgaagacttgaacaagtgggccctatttcttgtgtctccttttatacttgaagcagaacacatagcatttgtgacggagagcatttgggtacaaagtgagaatttacagagatcatcctcttcagaaacaattgtcaagtggtcagactgttgtttgccattagcttgcagacctggggatccttatcggctaattgctgaagcaagtgtggacaacttcagcaagctgggggtggcgttcatggaagatagactccacatggataatggactggtaccccaaaagattgtgtcggtgcacttgcaggactccactctgaaggaagttaaggatcaggtctcaaacaagcaagcccagatcctagagccgaagcctgaaccttctcttgagattaagcctgagcaggacggtatggagcatgttggcagagatgacccaaaggctcttggtgaagaacccaaacaaaggagaggcagtgcctctgggagtgagcctgctggggacagtgacaggggag

SEQ ID NO: 13821 - DNA, 2277 bp, Homo sapiens
gtgcgtgagaacgccggcggtgaccgcagccacagcggtgaccgagtgagaggaaggcggcggcggcggcggcggcggcgtgaagtcactgctgctctgggttcgggttggcgactgaaggcggtaccggcctcccggaacagcccgggggagggcttaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggt

SEQ ID NO: 13822 - DNA, 1072 bp, Homo sapiens
ggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 13823 - DNA, 1000 bp, Homo sapiens
ccgagtgagaggaaggcggcggcggcggcggcggcggcgtgaagtcactgctgctctgggttcgggttggcgactgaaggcggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 13824 - DNA, 2517 bp, Homo sapiens
aggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcgccacccccagccggctacctaccagacttccgggaacctgggggtgtcctactcccactcaagttgtggtccaagctatggctcacagaacttcagtgcgccttacagcccctacgcgttaaatcaggaagcagacgtaagtggtgggtacccccagtgcgctcccgctgtttactctggaaatctctcatctcccatggtccagcatcaccaccaccaccagggttatgctgggggcgcggtgggctcgcctcaatacattcaccactcatatggacaggagcaccagagcctggccctggctacgtataataactccttgtcccctctccacgccagccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaagtttcaggtatgcttaagcatccgtgtatttggctgggctacaatttgttaattcctatgaagttggcacatttcatgaggggaaagggagaagggtggtaaatattttcaaagagatgggccttttcttgaataaaagttaataacagctcctttattataatcaaagctcataatggaaaaaaagactgatgaagaaatttatgaagcagatttatttttgaaacaaacatggatacttcctgggtcaagtgctaaccttttcacctccaactggatgttgacgtatatataaacagaactcccttcaaaagccaaaa

SEQ ID NO: 13825 - DNA, 2016 bp, Homo sapiens
tttttcttctccggccccatggaggaagtgagaaagttggcacagtcacgccgggcttcgcaggaccaggtcactcagtgacagatggacaatgcaagaatgaactccttcctggaataccccatacttagcagtggcgactcggggacctgctcagcccgagcctacccctcggaccataggattacaactttccagtcgtgcgcggtcagcgccaacagttgcggcggcgacgaccgcttcctagtgggcaggggggtgcagatcggttcgccccaccaccaccaccaccaccaccatcgccacccccagccggctacctaccagacttccgggaacctgggggtgtcctactcccactcaagttgtggtccaagctatggctcacagaacttcagtgcgccttacagcccctacgcgttaaatcaggaagcagacccaccaagaagcctgtcgctcccccgcatcggagacatcttctccagcgcagacttttgactggatgaaagtcaaaagaaaccctcccaaaacagggaaagttggagagtacggctacctgggtcaacccaacgcggtgcgcaccaacttcactaccaagcagctcacggaactggagaaggagttccacttcaacaagtacctgacgcgcgcccgcagggtggagatcgctgcatccctgcagctcaacgagacccaagtgaagatctggttccagaaccgccgaatgaagcaaaagaaacgtgagaaggagggtctcttgcccatctctccggccaccccgccaggaaacgacgagaaggccgaggaatcctcagagaagtccagctcttcgccctgcgttccttccccggggtcttctacctcagacactctgactacctcccactgaggcggctccagccccagacaacagcccaggcatctccttgggctgggacttcttacccaaagcacatgcttagcttatctttctttccatttacagtctctttcttcctttctaatcctatctggggagctcctggccaggataatatatttgcagataattctggaccagagacttggtgcggggttaacaccttcatccagattgggtgccagcatacattttctggtgggccttaacatccctcctgcttttaggagaattcacagaacctactgttcctttcagatgaccttttggaaaatagttccctttgccaacagaaacatgccagaaggaatcttctcatcttttatctaactatatgtacagctctcccctcccttgtccttgaaagtaggatatagcgaaaggcgagtccaggagctcaggaagaagagatgcactatatgtttacacaattaattcatcccttaatttaagtcattttcatgtgtgtgagtttgctggttgtaaatactttgtcctaagagatttatctttatacagattttctagaaatgtttaggttactaaaacagggtgggcaaactctctaaactggtacaattttataggtgaaagaaaaaattccctcatttaaacccaatcagatgcctcagagggtagccttgatttgttcttacagttaagaagccctgcagagcacaaacttcagaaacccggcttcctgtgctaagtctttcccaatctctacccctttcttctcgggccaccctctgtttaaaatttgtgctgggttattcagaacctaaaagtattattcaaaccaatttcttccttccacagttatcttagctggatataatgtattttcagctcaattgttaatgtgatggatggcacaatgaatgtatattttgtgttattcgtgaatagtcttttgcatgtcgcacaatgtttgatgtccccaaagtaccacactgagttctatcagttatcctttgtgagcctatgatattccccatttcctgtacaatcatgaacagctctgagatcctggagtgatatgatccagagcagagtttacgggtcttaggatgtctgtaataaataaatatactcaa

SEQ ID NO: 13826 - DNA, 2541 bp, Homo sapiens
atgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaatttta

SEQ ID NO: 13827 - DNA, 1569 bp, Homo sapiens
aaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagcttt

SEQ ID NO: 13828 - DNA, 1570 bp, Homo sapiens
aaccaaagtctctcaagttgctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaa

SEQ ID NO: 13829 - DNA, 2295 bp, Homo sapiens
cttcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaa

SEQ ID NO: 13830 - DNA, 4376 bp, Homo sapiens
actggggtcttctccatgcggctcgggctatgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcggcggccgcggctgcggcggcggccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcgggcgcagaggccgccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacatgatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgccattaaaatctgcagaaaatactctttactttcctatgctaaatgtgcactgcacagaaagaaaaggagcaggtttatcttatataaaccaaggaccattctttattattattcagtacttcttttgctaccaaatttttaagaaaagggagaaatccctcataactaaaatcctaaaaaatgataagtgcttcaaggagattaaagtgtcaggtattacaaaagggagagaaaagaaaggaggaagagatagtatgaattcccaggctccctgtggaaaatgaaaaccagttgttttgtagcagcaatgcctaggctgtcgtattttaaaatctgctgttgggtctgcatgtgtctgagagggcaggttttgatatttgttgaaatgacaggactacgaaaggccttaaaccttgaccttgacgaaaaaaaagacaatttgtgaccttgacttttgacagctcatgaattggccttagctggattagtagatcaagggcgccacctcgcgttgacaagcctccttgtaattcttcaaccaagggaatcaagagctcttacctccttgactttagagattcagtactcaattatttggctccagctggagcaaatttgaatatatgtaaattatacatgtccctgtatatatgtaaatatatataatatgtgtacacatgtatacatttgcatattagtgcttgtgtgtgcttgtatatatatttgtagaatctgtacagatatcatatcattaattgctaatgacgcaagatattgtaatttaaggtgatttctagaattgaggtacaaaatgtactttacaagatgaagccttgttccttttctctaatggccaaatttgatttgtcttcacagtggcttgctctgcatcagatttctgcagatctgctttaaagctgtacatttttgttacagtctaagatgtgttcttaaatcaccattccttcctggtcctcaccctccagggtggtctcacactgtaattagagctattgaggagtctttacagcaaattaagattcagatgccttgctaagtctagagttctagagttatgtttcagaaagtctaagaaacccacctcttgagaggtcagtaaagaggacttaatatttcatatctacaaaatgaccacaggattggatacagaacgagagttatcctggataactcagagctgagtactgctccagggtggtgtgcaatcttatattgatgcttgtgaatctgccatttgatttgtaggataaataaatatgtttaatattaacaacttccatcaaaactataataataatattatatctactgttgacctctaacaacaatcaggtgctgtattcagagtcataaagaatacatatgtatgtttgtatatttaatatacacataggataatgtgtttttgtcaaatctatgctatgcgcatatgtattaaaatgttggtggaatcagtagccgtgggatgcagaattgtgagatgcaggctaattttatctttacgttagaggaaagtaatagtgaatggaagaaccagattcatcattttatggaaaataatattgattggttacaaaagtggctgccggaaacctctccaacctctcctgaggactcacaacttctttatagatgagaattacgaaagagtctctaaagctgtctcaaaaacaggctggtgttgaaacatacatatcgaaaggtctcgagaaattcaattatattttgctgccctgaggattttcactccacttgtggaaacaaatgataatgttgcttcagacccacctctccacctcttgttccaaacagtactccatttccaaatgagctgccatcaag

SEQ ID NO: 13831 - DNA, 2066 bp, Homo sapiens
cccgacttttttggatcaatcaaacagacagtggcttcttttgattaaagcccaaattgtcattgggcagaagcaatcatgtgacagccaattcggtccaatttcaaccttgtctccatgaattcaatagtttaatagtagcgcggtccccatacggctgtaatcagtgaattagaaaaaaaacaccctagcagcgatattctatgatagattttttttcctctgcgctcgcctttttcctaggccttgcccccccaaagcccctccaaaagagggaactttttctctgagggggctccaaggagaaggccatgaattacgaatttgagcgagagattggttttatcaatagccagccgtcgctcgctgagtgcctgacatcttttccccctgtcgctgatacatttcaaagttcatcaatcaagacctcgacgctttcacactcgacactgattcctcctccttttgagcagaccattcccagcctgaaccccggcagtcaccctcgccacggcgctggcggccgccccaagccgagccccgcgggcagccgcggcagcccggtgcccgccggcgccctgcagccgcccgagtacccctggatgaaggagaagaaggcggccaagaaaaccgcacttctgccggccgccgccgccgccgccaccgccgcagccaccggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggattttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagtagcttatttttctccccctcttttttcaaggctcataacgggttctttttcttcttttagtctaacttcgtaaataaaattcgtcacaatttatcctcttttttcaattttaatacatttattaaggcggcatgttcaaagtcttcaatggacagcaacaaaacagaaagccaaaaaatgactagggcttctaataagtgttttttctttcttttttgcttcttcttctcctctttctttttaaaggatttga

SEQ ID NO: 13832 - DNA, 1747 bp, Homo sapiens
ggcctcggcaagcccagaaaaaacgacaacgcgagaaaaattagtatttttgcacttcacaaattaatgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtggatacctgagaaggactacttggtatcaaatacttttgagatggctacagtcagctagctggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccatttaaaaaacattaaaaatctaagattca

SEQ ID NO: 13833 - DNA, 1595 bp, Homo sapiens
atgaccatgagctcgtttttgataaactccaactacatcgagcccaagttccctcccttcgaggagtacgcgcagcacagcggctcgggcggcgcagacggcggcccgggcgggggccccggctaccagcagcccccagcgcccccgacccagcacctgccgctgcagcagccccagctccctcacgcgggcggcggccgagagcccactgcctcctactacgcgccgcggaccgcccgcgagcccgcctaccctgctgccgcgctgtaccccgcgcatggggccgcggacaccgcctacccctatggctaccgcggcggcgccagccccgggcggccgccccagcccgagcagcccccggcgcaagccaagggcccagcgcacggcctgcatgcgagccacgtcctgcagccccagctgccgccgcccctgcagcctcgcgccgtgcccccagcggccccgcggcgctgcgaggcggcccccgccaccccaggcgtcccggcagggggcagcgcccccgcgtgcccgctgctcttggccgacaagagcccgctgggcctgaagggcaaggagcccgtggtgtacccctggatgaagaagatccatgtcagcgccgttaaccccagttataacggaggggagcctaagcgctctcgaaccgcctacacccggcagcaggtcttggagctggagaaggagttccacttcaatcgatacctgacccggcggcgccgcatcgagatcgcccacacgctctgtttgtctgagcgccaggtcaagatctggtttcagaaccggaggatgaagtggaagaaagaccacaaactgcccaacaccaagatgcgatcctccaattcggcctcggcctctgccggcccaccagggaaagcacaaactcagagcccacacctccatccccacccccacccgagcacctccacacccgttccctcctccatataatcttctagagatcttaaccagtttctatcccttacctgcttttctcttctcttctcctgctccgttcctcatccacccctccccatctggaccataatagacaccaaaacaaacccaaattggtgaaaagaataatcaaaaagaagacattatccggttaagagtctgtgctggttgccacccaagagagaacagttgtccaggatgctggctggtggaacaacctgctggcccgaaacaaggctgccaggtgtgggacagcccatgctgagtggggacatacacttgcatctttgttgaaagcagaagaagacagaccctttccccaccttccttacctcctcttcccccattaaggcagctcatccaagcttgtatttaactgaataaatgagtagacattgtggacctcacaagattatttaattcttaagatgtgtagaccttgatggtaggtgtgacatgttagtttttcttacttgcatttatttaagacactgttacagagatactgttgtccccttctggggcacggtctttggggagaggggagtgcatttagacttatgtggaactgtacaaattgtgatgtggctacatagaaagccatgtgctaagaataaactccattt

SEQ ID NO: 13834 - DNA, 1657 bp, Homo sapiens
gggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatgacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgtgtaattaatgctgttgtagaggtgacttgatgagacacaacttgttcgacgtgtagtgactagtgactctgtgatgaaaactgtgactccaagcggtgtgtccctgcgtgcctttataggaccctttgcacgaactctggaagtggctcttataagcgcagcttcagtgatgtatgtttttgtgaacaaagttacaaatattgtccaagtctggctgttttaagcaaactgtgatcagcttttttttttttttttttttttttgtatttgtttttaaggaaaaaatactgactggaacaaaaaataaactttctattgtaagttc

SEQ ID NO: 13835 - DNA, 989 bp, Homo sapiens
cacagtcctgcagaggggcgcgcaaatgagttcctattttgtgaatcccactttccccgggagccttcccagcggccaggactccttcttgggccagctgcccctctaccaggctggctatgacgcgctgaggcccttcccggcctcgtacggggcgtcgagtctcccggacaagacgtacacctcaccttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacaccca

SEQ ID NO: 13836 - DNA, 2020 bp, Homo sapiens
acgtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctttgctcccaactcacagagaagcggctacggggcgggcgccggcgccttcgcctcgaccgttccgggcttatacaatgtcaacagccccctttatcagagcccctttgcgtccggctacggcctgggcgccgacgcctacggcaacctgccctgcgcctcctacgaccaaaacatccccgggctctgcagtgacctcgccaaaggcgcctgcgacaagacggacgagggcgcgctgcatggcgcggctgaggccaatttccgcatctacccctggatgcggtcttcaggacctgacaggaagcggggccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaatgtaaaaaacaaaaacaaaaacaaaaaagcaacccagtccccaacctgcactctacccacccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgcaagaaagtgaatctcactactacctactcccctaaaactacctattttgtgctggctggcttgcctgctacctagtgccgactgctcccaggcaagtcccctgctgcttacagcccgcagcttttggggtccctgaggctgccctgagaatgtgctgaggtccaggatcagggtattggcatctatttaaatcgaaaaataatatatttattccaaaaagcatcctaagtgcttgcaccctagaatcaatccctccttctctggcttggcacccacagctcaggcccatcaacccccacttctggaggggaatgttcctgagctggctgcagatctgtgggttagcttctgcttagcaggactgtggagatgcttccagcttcgctgtcctttcctctggctcctgtatcttactgttcagctgtgttaaatatgtacgccctgatgtttcctataatagcagatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtaaccgaaaataaagatgcgtggtgacaaagaaaaa

SEQ ID NO: 13837 - DNA, 585 bp, Homo sapiens
gggcagtttatgaggcgtttaggggaagggttctccccaccatcctccaccgagcggtgggcggcaggggcttcagctggtgcaacatggtgcaggggtcggaggcctggaagggcggataaacagtgtgcctccgattaaggaaaggaagctgggagacgttgactttattcgaaccacatggctccagtttgcggtggcaatctctctgcagctgcaagagatgctgcgccttccccgtctggatccgagtctaagtccggcctgtcgcccactggacctgggcggctgcgggccctgcggagcgagaccacctgtgaggactgctgagattggcggaggcggtcatgtgggcggtcacgtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctt

SEQ ID NO: 13838 - DNA, 1956 bp, Homo sapiens
caccactggggcggcaactactacgtggactcgttcctgctgggcgccgacgccgcggatgagctgagcgttggcatgcgccggggaccctggcctccccggcaggcggcgacgctggccgagcaccccgacttcagcccgtgcagcttccagtccaaggcgacggtgtttggcgcctcgtggaacccagtgcaccgggcgccaacgctgtacccggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttct

SEQ ID NO: 13839 - DNA, 2037 bp, Homo sapiens
agtttcataatttccgtgggtcgggccgggcgggccaggcgctgggcacggtgatggccaccactggggccctgggcaactactacgtggactcgttcctgctgggcgccgacgccgcggatgagctgagcgttggccgctatgcgccggggaccctgggccagcctccccggcaggcggcgacgctggccgagcaccccgacttcagcccgtgcagcttccagtccaaggcgacggtgtttggcgcctcgtggaacccagtgcacgcggcgggcgccaacgctgtacccgctgcggtgtaccaccaccatcaccaccacccctacgtgcacccccaggcgcccgtggcggcggcggcgccggacggcaggtacatgcgctcctggctggagcccacgcccggtgcgctctccttcgcgggcttgccctccagccggccttatggcattaaacctgaaccgctgtcggccagaaggggtgactgtcccacgcttgacactcacactttgtccctgactgactatgcttgtggttctcctccagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttcta

SEQ ID NO: 13840 - DNA, 1755 bp, Homo sapiens
atggcagggttctctccttggcggcggcggcagcggcggaggcggcggcggcggcgggcgaggcagtcgcgggcagcaccagaactggtcggtgatttaggtagtttcctgttgttgggatccacctttctctcgacagcacgacactgcttcattacttcagttgaaatcgtctccaggtacctctgcgcgcgggggtcgggccgggcggggcatcacggccctggtcgtgccaggcctgcggtggcaacctcggctttccctgctcaggagcctcgtgtctttctccgcagcgctttgccagccggccggctttccccttccaccacacacctccacctggtcacagcagataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttccagaaccgcaggatgaaaatgaagaaaatcaacaaagaccgagcaaaagacgagtgatgccatttgggcttatttagaaaaaagggtaagctagagagaaaaagaaagaactgtccgtcccccttccgccttctcccttctctcacccccaccctagcctccaccatccccgcacaaagcggctctaaacctcaggccacatcttttccaaggcaaaccctgttcaggctggctcgtaggcctgccgctttgatggaggaggtattgtaagctttccattttctataagaaaaaggaaaagttgaggggggggcattagtgctgatagctgtgtgtgttagcttgtatatatatttttaaaaatctacctgttcctgacttaaaacaaaaggaaagaaactacctttttataatgcacaactgttgatggtaggctgtatagtttttagtctgtgtagttaatttaatttgcagtttgtgcggcagattgctctgccaagatacttgaacactgtgttttattgtggtaattatgttttgtgattcaaacttctgtgtactgggtgatgcacccattgtgattgtggaagatagaattcaatttgaactcaggttgtttatgaggggaaaaaaacagttgcatagagtatagctctgtagtggaatatgtcttctgtataactaggctgttaacctatgattgtaaagtagctgtaagaatttcccagtgaaataaaaaaaaattttaagtgttctcggggatgcatagattcatcattttctccaccttaaaaatgcgggcatttaagtctgtccattatctatatagtcctgtcttgtctattgtatatataatctatatgattaaagaaaatatgcataatcagacaagcttgaatattgtttttgcaccagacgaacagtgaggaaattcggagctatacatatgtgcagaaggttactacctagggtttatgcttaattttaattggaggaaatgaatgctgattgtaacggagttaattttattgataataaattatacactatgaaaccgccattgggctactgtagatttgtatccttgatgaatctggggtttccatcagactgaacttacactgtatattttgcaatagttacctcaaggcctactgaccaaattgttgtgttgagatgatatttaactttttgccaaataaaatatattgattcttttct

SEQ ID NO: 13841 - DNA, 1358 bp, Homo sapiens
attcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagaggaaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctccccaaccccaggcctgggcttcactggcctggggatcctctctagggctgaaatgccagtttagagctgcctgggggtgggaggggggatggggaaacatttttctcagacctgggtggctgggggccctacaggaccagaggcctgggaggcatggaacctgtcaaatgtagagggaagggcttctgcctttgatctggggatcagctcagtgtcaacatgtggtgggggtgggggccagcctcatcctcctggattcatcctcctttcccttccaacttgggtttatt

SEQ ID NO: 13842 - DNA, 3467 bp, Homo sapiens
aggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaa

SEQ ID NO: 13843 - DNA, 528 bp, Homo sapiens
ccccgctgcccccccggcccccgagttcccttggatgaaagagaagaaatccgccaagaaacccagccaatccgccacgtctccttctccggccgcctccgccgttccggcggggtcggatcgcctgcagatggcctgggacggaggctggtggcggcggggcaggctgcgcacggcttacaccaacacgcagctgctggaactggagaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggccccctcgcgggcggcgtgggaagcctgctgtcacccgccggaggtggtgccgggggccttaagcgcggacccccggcctttagccgttcgcttagaggg

SEQ ID NO: 13844 - DNA, 2652 bp, Homo sapiens
cttttttcttttttaactagcacaatggcaaaaatgggagggaaagtctctttgtcctaggggaaaatctccccaccacactcatgcacacacataacgctgatctgaactttgagagtgctctaagttaaaccaatggctacctcagttcttgttcatgtccctggatatggatacagatacaagcttgaggcttgagtgggtacatgcacatcttagactctgcctgtttttgggggatgtcacagagaagcatggaagcctgaaagtgaggaaagcaggggtacataaggggcagaggcagtgctgcaaacactgggcagagaagagaacccagaccatacagcgatggaggccagaggcccaaaaatgccccttatgctccatctcactcctatgtgtctgcctgggagttcctgtccatttcccaagatttaactgttgtttttggagggtaacagggatagtggtgtgatgattgtaaatctctttcttattttcaccttaatactgacctttttcaaagagtggaagcctctttcgactccctcttcctccaacgcggagatcctcactcatcttttcctggggaaggggagaagggaaggggatgctgctggccacgtaaagaaggccttaatttactctattaaaatacttggaaaagaggaaggtttctcccttagagtctcttcttttccaggcttctgaaaccttctaaccttcgaaggggatgaggaaaaggttcctctagcttttctggagaaacggaggcattggggagagagcatgtgaggcactggtgtaggaatgggggctcatggtgtcctggtcgtggtcctctggtgtttttgaatcaattaaaccaaataatgctctctgttttccaccaggcccagacgagcgattggcggaggccggtcccgtgaccacgaattccctgtaatttcgctggagtcctgggtttaatagagagagtccccatacgcttgtatttatcagcaatatacaattataaaggcccaaaattaaaaaaaagagagaccgaaatctccccctcccaaaatcgctccattacataaatcggggggggtgcaggaggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaa

SEQ ID NO: 13845 - DNA, 2642 bp, Homo sapiens
ttttgcattcctccagcttgcagctccggtagttggaggctgggtagggcagggggaaccgacaggccggtgtccccagccgcaaaagagctgctgaactgtccgtttaaatgctgctgggagactcgtaaaaaaatcatcgtggacctggaggatgagaggggcgagctttatttcggtcggattgcggtgtggtggtttagctgcaaggggatgccgcagccccagttgagggggaaaatagttcttaaaaagcatatgcccccctaaggaatgtctctaaagaaccaaatcaaagctgctctttggaaggtatgaatagaatttaaaaaaaaaagatttctatggagcttaaagttcacagccattctgtgtagacaagagctaagaaaaatgtgagaattatacagaaaaccattaatcacttcttttctttaaatacgtatcctctctcctttgttattattcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatccttt

SEQ ID NO: 13846 - DNA, 1525 bp, Homo sapiens
actttaactgctcgctgtggtggggaagggggcagaggtaggtgagcactctcccagcctggagcagccggaccagcccagaaggcagcggcggcccaggccagcattcccgcagacacaagaggcttaagtacggcaaagcctttcatatcgtgatttatttgtcataagcaaataaaatgcggttaagctgtctccttttagacagaaggctctttggttattaaagttccgagagaggattccatgaggctggcctctttcctcgcagcataagaagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaa
